(12) United States Patent
Progulske-Fox et al.

(10) Patent No.: US 7,416,852 B2
(45) Date of Patent: Aug. 26, 2008

(54) **IDENTIFICATION OF *PORPHYROMONAS GINGIVALIS* VIRULENCE POLYNUCLEOTIDES FOR DIAGNOSIS, TREATMENT, AND MONITORING OF PERIODONTAL DISEASES**

(75) Inventors: Ann Progulske-Fox, Keystone Heights, FL (US); Jeffrey Daniel Hillman, Gainesville, FL (US); Martin Handfield, Gainesville, FL (US)

(73) Assignee: University of Florida Research Foundation, Gainesville, FL (US)

( * ) Notice: Subject to any disclaimer, the term of this patent is extended or adjusted under 35 U.S.C. 154(b) by 61 days.

(21) Appl. No.: 10/915,002

(22) Filed: Aug. 10, 2004

(65) Prior Publication Data

US 2006/0078950 A1 Apr. 13, 2006

Related U.S. Application Data

(60) Provisional application No. 60/495,589, filed on Aug. 15, 2003.

(51) Int. Cl.
*G01N 33/53* (2006.01)
(52) U.S. Cl. .................................... 435/7.32
(58) Field of Classification Search ................ None
See application file for complete search history.

(56) References Cited

U.S. PATENT DOCUMENTS 6,444,799 B1 * 9/2002 Ross ........................ 536/23.1

FOREIGN PATENT DOCUMENTS

WO 0111081 2/2001

OTHER PUBLICATIONS

Greenspan et al. Nature Biotechnology 7: 936-937, 1999.*
Bowie et al. Science, 1990, 247:1306-1310.*
Zafiropoulos et al. J. Periodontol., 63:80-86, 1992.*
Ebersole et al., J. Periodontol., 63:1110-1116, 1992.*
Celenligil et al. J. Clin. Periodontol., 25:994-1002, 1998.*
Cellular and Molecular Immunology, 5th ed., Elsevier Saunders, 2005, pp. 522-524.*
(see Colman, Res. Immunol., 145:33-36, 1994).*
Illustrated Stedman's Medical Dict., 24th ed., 1982, p. 1057.*
Cruse et al., Illustrated Dict. of Immunology, 2nd ed., CRC Press, 2003, p. 46.*
McGuinness et al. (Mol. Microbiol., 7:505-514, 1993).*
Moudallal et al. (EMBO Journal, 1:1005-1010, 1982).*
Mahan, et al., "*Selection for Bacterial Genes that are Specifically Induced in Host Tissues: The Hunt for Virulence Factors*", Infectious Agents and Disease, 2:263-268, 1994.
Mahan, et al., "*Antibiotic-based selection for bacterial genes that are specifically induced during infection of a host*", Proc. Natl. Acad. Sci., vol. 92, p. 669-673, 1995.
Rainey, et al., "In vivo *expression technology strategies: valuable tools for biotechnology*", Current Opinion in Biotechnology, 11:440-444, 2000.
Handfield, et al., "In Vivo-*Induced Genes in Pseudomonas aeruginosa*", Infection and Immunity, vol. 68, No. 4, p. 2359-2362, 2000.
Wu, et al., "*Identification and Testing of Porphyromonas gingivalis Virulence Genes with a pPGIVET System*", Infection and Immunity, vol. 70, No. 2, p. 928-937, 2002.
Cutler, et al., "*Pathogenic strategies of the oral anaerobe, Porphyromonsa gingivalis*", Trends in Mircobiology, Vo. 3, No. 2, p. 45-51, 1995.
Handfield, et al., "*IVIAT: a novel method to identify microbial genes expressed specifically during human infections*", Trends in Microbiology, vol. 8, No. 7, p. 336-339, 2000.
Löe, et al., "*Early Onset Periodontitis in the United States of America*", J. Periodontol., vol. 62, No. 10, p. 608-616, 1991.
Nelson, et al., "*Complete Genome Sequence of the Oral Pathogenic Bacterium Porphyromonas gingivalis Strain W83*", Journal of Bacteriology, vol. 185, No. 18, p. 5591-5601, Sep. 2003.
International Search Report dated Jul. 8, 2005 for PCT/US2004/025778.

* cited by examiner

*Primary Examiner*—Shanon A. Foley
*Assistant Examiner*—Brian J Gangle
(74) *Attorney, Agent, or Firm*—McDonnell Boehnen Hulbert & Berghoff LLP

(57) ABSTRACT

The invention provides compositions and methods for the detection of *Porphyromonas gingivalis* and for the treatment and prevention of diseases and infections caused by *P. gingivalis*.

3 Claims, No Drawings

IDENTIFICATION OF *PORPHYROMONAS GINGIVALIS* VIRULENCE POLYNUCLEOTIDES FOR DIAGNOSIS, TREATMENT, AND MONITORING OF PERIODONTAL DISEASES

PRIORITY

This application claims the benefit of U.S. provisional application Ser. No. 60/495,589 filed on Aug. 15, 2003.

GOVERNMENT INTERESTS

This invention was made with Government support under Grant Number RO1 DE10994-01A2 awarded by the National Institutes of Health. The Government has certain rights in the invention.

INCORPORATION BY REFERENCE

Material on a compact disk, submitted herewith, is incorporated by reference herein in its entirety. The compact disk contains a file named "Univ of Florida (July 1).ST25". The file was created on Aug. 3, 2004 and contains 1,009,664 bytes.

TECHNICAL AREA OF THE INVENTION

This invention provides methods and compositions for the diagnosis, treatment, prevention, and amelioration of diseases and infections caused by *Porphyromonas gingivalis* (Pg).

BACKGROUND OF THE INVENTION

*Porphyromonas gingivalis* is an important etiologic agent of periodontal diseases. It is estimated that over 49,000,000 people in the United States have some form of periodontitis (Cutler et al., Trends Microbiol. 3:45 (1995)). Periodontitis occurs with higher frequency in patients with systemic disease such as diabetes mellitus, AIDS, leukemia, neutropenia, Crohn's disease, and Down's syndrome (Neville et al., Oral and Maxillofacial Pathology. Philadelphia: Saunders, 1995). Currently, standard microbiological tests for Pg detect only the presence of Pg in dental plaque, but do not specifically identify disease activity. For this reason, these tests have a low positive predictive value. Because Pg is normally found in plaque of even healthy individuals, the application of these tests is limited in their usefulness to those who present with certain clinical manifestations of disease. These include the following: 1) patients with advanced attachment loss and bone loss before the age of 25; 2) Patients, usually aged 25-35, with rapid destruction of attachment and bone in a relatively short period of time (rapidly progressive periodontitis); 3) patients who continue to lose attachment despite stringent treatment (refractory periodontitis); and 4) patients older than 35 who have a slow rate of attachment loss.

Diagnostic tests are needed in the art for other types of patients including, for example: 1) certain preadolescent children whose mothers have a history of periodontitis who are in need of tests that will determine if thy have acquired a predisposition for the disease, including, for example, Papillon-Lefevre syndrome (PLS), hypophosphatasia, neutropenias, leukocyte adhesion deficiency (LAD), Chediak-Higashi syndrome, Down's syndrome, leukemia, histiocytosis X, early-onset Type 1 diabetes, and acrodynia; 2) other preadolescent children who are less prone would also benefit from such a test since there are no other predictors or known risk factors; 3) adults already diagnosed or not yet diagnosed would benefit from knowing whether or not they have Pg present that are disease primed.

A national survey of the United States revealed a prevalence of localized juvenile periodontitis of 0.53% and of generalized juvenile periodontitis of 0.13%. Loe & Brown, *J. Periodontol*. 62:608-616 (1991). Findings from a number of studies corroborate the conclusion that early-onset disease is similar in other industrialized countries and is more frequent in developing countries. Loe & Brown, *J. Periodontol*. 62:608-616 (1991). In addition, certain types of adult periodontitis, which in general is a very common condition affecting over half of the adult population, are likely to be cased by Pg. In short, a good diagnostic for Pg induced periodontal disease could became a standard operating procedure for dental practitioners worldwide. In should be noted that Pg can also cause extra-oral diseases such as endocarditis, thyroid gland abscesses, urinary tract infections, brain abscesses, and vertebral osteomyelitis.

There are antibiotic, surgical, and mechanical therapies for the treatment of Pg induced periodontitis, but no means for prevention. Tetracycline has been widely used in the treatment of early-onset periodontitis. There remains a concern, however, of strains developing resistance to tetracycline as well as the possibility of overgrowth of other pathogenic microorganisms subgingivally. Given the incidence of these diseases, a safe vaccine for Pg is needed. A vaccine can be, for example, a multivalent vaccine. Control of periodontal disease is also very important in light of recent attention to the possible role of periodontal infections as risk factors for systemic disease (e.g., coronary heart disease).

No significant advances in the diagnosis, treatment or prevention of periodontal diseases have occurred in the past three decades since antibiotic regimens were adopted. DNA probe technology and immunoassay technology has been developed to identify the presence of Pg in dental plaque, but these technologies are unable to distinguish between the Pg that is normally part of the dental plaque community and Pg that is involved in an actual disease process. Consequently, those dentists who use these technologies recognize that they do not provide a "gold standard" for diagnosing disease activity.

Early diagnosis of periodontitis is highly desirable. Currently, diagnosis is made by X-ray analysis usually long after the onset of the disease and after considerable damage to the supporting bone and tissue has occurred. Tooth loss is the ultimate detrimental effect of destructive periodontal disease. Most people have Pg as a normal member of their dental plaque, but it usually does not cause disease. When Pg does cause disease the human host mounts an enormous response but it is inevitably futile presumably because it is directed against the wrong Pg antigens.

Prevention is much preferred in medicine to treatment. Currently, the prevalence and severity of early-onset periodontal diseases is addressed with a combination of mechanical plaque removal and a variety of systemic and topically applied antimicrobial agents aimed at selectively removing or inhibiting pathogenic bacteria. An effective vaccine against Pg would effectively reduce the use of antibiotics to control the destructive aspects of the early-onset periodontal diseases.

Compared to the number of different infectious diseases, there are relatively few reliable diagnostic tests and vaccines. In large part this is because pathogens regulate expression of their genes that are essential to the disease process: important environmental signals that normally cause the bacteria to turn on virulence genes during an infection are missing when they

SUMMARY OF THE INVENTION

One embodiment of the invention provides an isolated immunogenic polypeptide comprising at least about 5 contiguous amino acids of an amino acid sequence selected from the group consisting of SEQ ID NOs:167-226, 228-261, and 263-354167-226, 228-261, and 263-354. The immunogenic polypeptide can be part of an isolated polypeptide which also comprises a heterologous polypeptide.

Another embodiment of the invention provides an isolated polypeptide comprising an amino acid sequence selected from the group consisting of SEQ ID NOs:167-226, 228-261, and 263-354.

Still another embodiment of the invention provides an isolated polynucleotide comprising a sequence that encodes an isolated immunogenic polypeptide comprising at least about 5 contiguous amino acids of an amino acid sequence selected from the group consisting of SEQ ID NOs:167-226, 228-261, and 263-354.

Even another embodiment of the invention provides an isolated polynucleotide comprising at least about 15 contiguous nucleic acids of a sequence selected from the group consisting of SEQ ID NOs:1-166, 227, and 262 and degenerate variants thereof.

Another embodiment of the invention provides an isolated polynucleotide comprising polynucleotide sequence of SEQ ID NOs:1-166, 227, and 262 and degenerate variants thereof. The polynucleotide can be operably linked to an expression control sequence. The polynucleotide can also be part of a heterologous polynucleotide. The polynucleotide can be in an expression vector and the expression vector can be in a host cell.

Still another embodiment of the invention provides an antibody, antibody fragment, or single-chain antibody that specifically binds to an isolated immunogenic polypeptide comprising at least about 5 contiguous amino acids of an amino acid sequence selected from the group consisting of SEQ ID NOs:167-226, 228-261, and 263-354. The antibody fragment can be selected from the group consisting of Fab, F(ab')$_2$, Fab' and Fab'-SH. The antibody can be a monoclonal antibody or a polyclonal antibody. The antibody, antibody fragment, or single-chain antibody can be present in a composition comprising a pharmaceutically acceptable carrier.

Yet another embodiment of the invention provides a method for treating or preventing a disease or infection caused by *Porphyromonas gingivalis* comprising administering to an animal an antibody, antibody fragment, or single-chain antibody of the invention, whereby a disease or infection caused by *Porphyromonas gingivalis* is treated or prevented. The disease can be localized prepubertal periodontitis, generalized prepubertal periodontitis, localized juvenile periodontitis, generalized juvenile periodontitis, rapidly progressive adult periodontitis, refractory adult periodontitis, endiocarditis, thyroid gland abscess, urinary tract infection, brain abscess and vertebral osteomyelitis.

Even another embodiment of the invention provides a composition comprising an isolated immunogenic polypeptide comprising at least about 5 contiguous amino acids of an amino acid sequence selected from the group consisting of SEQ ID NOs:167-226, 228-261, and 263-354 and a pharmaceutically acceptable carrier.

Another embodiment of the invention provides a method of eliciting an immune response in an animal comprising administering an isolated immunogenic polypeptide comprising at least about 5 contiguous amino acids of an amino acid sequence selected from the group consisting of SEQ ID NOs: 167-226, 228-261, and 263-354 to an animal, wherein an immune response is elicited.

Still another embodiment of the invention provides a method of treating or preventing a disease or infection caused by *Porphyromonas gingivalis* comprising administering an isolated immunogenic polypeptide comprising at least about 5 contiguous amino acids of an amino acid sequence selected from the group consisting of SEQ ID NOs:167-226, 228-261, and 263-354 to an animal, wherein the disease is treated or prevented.

Yet another embodiment of the invention provides a composition comprising an isolated polynucleotide comprising a sequence that encodes an isolated immunogenic polypeptide comprising at least about 5 contiguous amino acids of an amino acid sequence selected from the group consisting of SEQ ID NOs:167-226, 228-261, and 263-354 and a pharmaceutically acceptable carrier. The polynucleotide can be in a plasmid.

Even another embodiment of the invention provides a method of eliciting an immune response in an animal comprising administering an isolated polynucleotide comprising a sequence that encodes an isolated immunogenic polypeptide comprising at least about 5 contiguous amino acids of an amino acid sequence selected from the group consisting of SEQ ID NOs:167-226, 228-261, and 263-354 to an animal, wherein an immune response is elicited.

Another embodiment of the invention provides a method of treating or preventing a disease or infection caused by *Porphyromonas gingivalis* comprising administering an isolated polynucleotide comprising a sequence that encodes an isolated immunogenic polypeptide comprising about at least 5 contiguous amino acids of an amino acid sequence selected from the group consisting of SEQ ID NOs:167-226, 228-261, and 263-354 to an animal, wherein the disease or infection is treated or prevented.

Still another embodiment of the invention provides a method of detecting the presence of a first *Porphyromonas gingivalis* polynucleotide in a test sample. The method comprises contacting a test sample suspected of containing the first polynucleotide with a second polynucleotide under hybridization conditions, wherein the second polynucleotide is an isolated polynucleotide comprising a sequence that encodes an isolated immunogenic polypeptide comprising at least about 5 contiguous amino acids of an amino acid sequence selected from the group consisting of SEQ ID NOs: 167-226, 228-261, and 263-354. Hybridized first and second polynucleotide complexes are detected. The presence of a hybridized first and second polynucleotide complex indicates the presence of a first polynucleotide in the test sample.

Yet another embodiment of the invention provides a method of detecting the presence of a *Porphyromonas gingivalis* antibody in a test sample. The method comprises contacting a test sample with an isolated immunogenic polypeptide comprising at least about 5 contiguous amino acids of an amino acid sequence selected from the group consisting of SEQ ID NOs:167-226, 228-261, and 263-354, wherein the polypeptide specifically binds a *Porphyromonas gingivalis* antibody under conditions that allow formation of an immunocomplex between the antibody and the polypeptide. An immunocomplex is detected. Detection of the immunocomplex indicates the presence of a *Porphyromonas gingivalis* antibody in the test sample.

Even another embodiment of the invention provides a method of detecting the presence of *Porphyromonas gingivalis* or a *Porphyromonas gingivalis* polypeptide in a test sample. The method comprises contacting a test sample with an antibody, antibody fragment, or single-chain antibody of the invention that specifically binds *Porphyromonas gingivalis* or a *Porphyromonas gingivalis* polypeptide under conditions that allow formation of an immunocomplex between the antibody and the *Porphyromonas gingivalis* or the *Porphyromonas gingivalis* polypeptide. Immunocomplexes are detected. Detection of immunocomplexes indicates the presence of *Porphyromonas gingivalis* or a *Porphyromonas gingivalis* polypeptide in the test sample. The *Porphyromonas gingivalis* polypeptide can be expressed in vivo during infection of an animal.

Another embodiment of the invention provides a method for detecting *Porphyromonas gingivalis* infection in a subject. The method comprises obtaining a biological sample from the subject and contacting the biological sample with an isolated immunogenic polypeptide comprising at least about 5 contiguous amino acids of an amino acid sequence selected from the group consisting of SEQ ID NOs:167-226, 228-261, and 263-354 under conditions that allow formation of immunocomplexes between the polypeptide and *Porphyromonas gingivalis* antibodies present in the biological sample. The amount of immunocomplexes formed is detected. The amount of immunocomplexes detected is compared to a control sample. A higher amount of immunocomplexes in the biological sample than the control sample indicates a *Porphyromonas gingivalis* infection in the subject.

Still another embodiment of the invention provides a method for detecting *Porphyromonas gingivalis* in a subject. The method comprises obtaining a biological sample from the subject and contacting the biological sample with an antibody, antibody fragment or single-chain antibody of the invention under conditions that allow formation of immunocomplexes between the antibody, antibody fragment, or single-chain antibody and *Porphyromonas gingivalis* polypeptides present in the biological sample. The amount of immunocomplexes formed is detected and the amount of immunocomplexes detected is compared to a control sample. A higher amount of immunocomplexes in the biological sample than in the control sample indicates a *Porphyromonas gingivalis* infection in the subject.

Yet another embodiment of the invention provides a method for detecting *Porphyromonas gingivalis* in a subject. The method comprises obtaining a biological sample from the subject, contacting the biological sample with an isolated polynucleotide comprising a sequence that encodes an isolated immunogenic polypeptide comprising at least about 5 contiguous amino acids of an amino acid sequence selected from the group consisting of SEQ ID NOs:167-226, 228-261, and 263-354 under conditions that allow formation of a hybridized complex between the polynucleotide and *Porphyromonas gingivalis* polynucleotides present in the biological sample. The amount of hybridized complexes formed is detected. The amount of hybridized complexes detected is compared to a control sample. A higher amount of hybridized complexes in the biological sample than in the control sample indicates a *Porphyromonas gingivalis* infection in the subject.

Therefore, the invention provides compositions and methods for the detection of *Porphyromonas gingivalis* and for the prevention and treatment of diseases and infections caused by *P. gingivalis*.

DETAILED DESCRIPTION OF THE INVENTION

Methods of Identification of Polynucleotides and Polypeptides

Methods for identifying nucleotide sequences that are important to a microorganism's ability to cause disease has been applied to Pg, the principal etiologic agent of periodontal diseases, including, for example, early-onset periodontitis including localized prepubertal periodontitis, generalized prepubertal periodontitis, localized juvenile periodontitis, generalized juvenile periodontitis, rapidly progressive adult periodontitis, and refractory adult periodontitis. Pg can also cause endocarditis, thyroid gland abscesses, urinary tract infections, brain abscesses and vertebral osteomyelitis.

The methods used to identify polynucleotide and polypeptide sequences of the invention are termed in vivo induced antigen technology (IVIAT) (see Handfield et al., Trends Microbiol. 336:336-339 (2000); WO 01/11081) and In Vivo Expression Technology (IVET) (see Mahan et al., Proc Natl Acad Sci USA 92: 669-673 (January 1995); Handfield et al., Infect Immun 68: 2359-2362 (April 2000); Rainey & Preston, Curr Opin Biotechnol 11: 440-444 (2000).

Briefly, IVIAT comprises obtaining a sample of antibodies against Pg antigens that are expressed by Pg in vivo and in vitro and adsorbing the antibodies with cells or cellular extracts of Pg that have been grown in vitro. An example of a sample of antibodies that can be used is sera from patients who have been or are infected with Pg. The unadsorbed antibodies are isolated and are used to probe an expression library of Pg DNA. Reactive clones are isolated and the cloned fragments sequenced.

IVIAT was used to identify polynucleotides of Pg that are expressed only when Pg is engaged in actually causing disease in animals, and in particular humans. Important environmental signals that normally cause Pg to turn on virulence genes during an infection are missing when the bacteria are grown in the laboratory. Therefore, many of the best targets for diagnostic and vaccine strategies were unknown. IVIAT methodology was used to identify polynucleotides that are specifically turned on during growth of Pg in a human host and not during routine laboratory growth. These polynucleotides and corresponding polypeptides and antibodies are useful in developing diagnostic tests for Pg to identify, for example, subjects who are in early stages of infection and for monitoring response to therapy, and for developing vaccines or treatments to prevent or treat diseases caused by Pg in susceptible animals.

In vivo expression technology (IVET) provides powerful genetic tools for identifying and studying bacterial genes that are induced during infection of an animal model of infection. IVET is designed as a promoter trap method whereby random genomic fragments are ligated in front of a promoterless reporter gene (conferring antibiotic resistance for instance). Reporter activity can then be used as an indication of transcriptional activity of the fused gene. IVET was first used to identify in vivo-induced (ivi) genes in a mammalian pathogen in 1993 (Mahan et al. Infect Agents Dis. 2:263-8, 1993). An IVET strategy used herein was based on the fact that Pg is unable to survive passage through an antibiotic-treated mouse after sub-cutaneous inoculation. This strategy allows one to specifically select for a Pg genomic fragment that contains a promoter of a gene that is normally turned on during infection in the mouse and which confers antibiotic resistance to Pg. Only fusions that were active during infection result in expression of the antibiotic resistance marker and allow survival and multiplication of the strain in the animal. Most such strains had fusions that were also active during in vitro growth, i.e. these strains had constitutively active gene fusions. However, the subset of strains containing IVI gene fusions could easily be identifed by antibiotic screening of output colonies. Output strains that were antibiotic sensitive were said to contain gene promoters that were specifically active within the host environment, but not under laboratory growth of Pg. A limitation of the IVET approach with Pg is that it relied on a recognized animal model of infection as the basis for in vivo expression. This limitation was directly addressed with IVIAT.

Pg antigens identified by IVIAT and IVET have a high predictive value with regard to diseases caused by Pg, for example, periodontal diseases. Diagnostic tests for Pg can be useful in applications such as screening children whose mothers have a history of periodontitis to determine if the children have acquired a predisposition for the disease. Diseases known to be associated with periodontitis before puberty include Papillon-Lefevre syndrome (PLS), hypophosphatasia, neutropenias, leukocyte adhesion deficiency (LAD), Chediak-Higashi syndrome, Down's syndrome, leukemia, histiocytosis X, early-onset Type I diabetes, and acrodynia. Children with these diseases are candidates for Pg testing. Additionally, other preadolescent children who are less prone to periodontitis would benefit from a Pg diagnostic test since there are no other predictors or known risk factors.

Polypeptides

Isolated polypeptides of the invention can either be full-length polypeptides or fragments of polypeptides. For example, fragments of polypeptides of the invention can comprise at least about 5, 10, 25, 50, 100, 150, 200, 300, 400, 500, 600, 700, 800, 900, 1,000, 1,500, or 2,000 contiguous amino acids of polypeptides of the invention. Polypeptides of the invention comprise or consist essentially of those shown in SEQ ID NO:167-226, 228-261, and 263-354. These polypeptides will be referred to as "the polypeptide SEQ IDs." Polypeptides of the invention were discovered using IVIAT or IVET techniques. The polypeptides are described in Table 2. Where a polypeptide demonstrated homology to a known open reading frame in an organism, the name of the open reading frame and function of the open reading frame is given. The basic and novel characteristics of polypeptides of the invention that consist essentially of SEQ ID NOs:167-226, 228-261, and 263-354 is that they comprise or consist essentially of the sequence shown in SEQ ID NOs:167-226, 228-261, and 263-354 and that they specifically bind to a Pg-specific antibody, antibody fragment, single-chain antibody or aptamer of the invention.

In one embodiment of the invention, a polypeptide of the invention is immunogenic. That is, the polypeptide can elicit an immune response when it is administered to an animal.

In one embodiment of the invention, a polypeptide or fragment thereof is isolated. Isolated means that a polypeptide of the invention is substantially free from other biological molecules. A substantially isolated polypeptide is at least about 75%, 80%, 90%, 95%, 97%, 99% or 100% pure by dry weight. Purity can be measured by a method such as column chromatography, polyacrylamide gel electrophoresis, or HPLC analysis.

The invention also includes functionally active variants of polypeptides shown in SEQ ID NOs:167-226, 228-261, and 263-354. In one embodiment, the polypeptide includes an amino acid sequence at least about 75% identical to a sequence shown as SEQ ID NOs:167-226, 228-261, and 263-354, or a fragment thereof. The polypeptide can be at least about 75%, 80%, 85%, 90%, 95%, 98%, 99% or more identical to SEQ ID NOs:167-226, 228-261, and 263-354, and specifically binds to a Pg-specific antibody, antibody fragment, single-chain antibody or aptamer of the invention.

Specifically binds means that the polypeptide recognizes and binds to an antibody of the invention with greater affinity than to other, non-specific molecules. For example, an antibody raised against an antigen (e.g., a polypeptide) to which it binds more efficiently than to a non-specific protein can be described as specifically binding to the antigen. Binding specifically can be tested using, for example, an enzyme-linked immunosorbant assay (ELISA), a radioimmunoassay (RIA), or a western blot assay using methodology well known in the art.

A polypeptide is a functionally active variant if it reacts substantially the same as a polypeptide shown in SEQ ID NOs:167-226, 228-261, and 263-354 or an immunogenic fragment thereof in an assay such as an immunohistochemical assay, an ELISA, an RIA, or a western blot assay, e.g. has 90-110% of the specific binding activity of the original polypeptide. In one embodiment, the assay is a competition assay wherein the functionally active variant polypeptide is capable of reducing binding of a polypeptide shown in SEQ ID NOs:167-226, 228-261, and 263-354 to a corresponding antibody, antibody fragment, single-chain antibody or aptamer by about 80, 95, 99, or 100%.

Functionally active variants can also comprise "polypeptide fragments" of the invention. Polypeptide fragments comprise or consist essentially of about at least 5, 10, 25, 50, 75, 100, 150, 200, 300, 400, 500, 600, 700, 800, 900, 1,000, 1,500, or 2,000 amino acids of SEQ ID NOs:167-226, 228-261, and 263-354.

As used herein, percent identity of two amino acid sequences (or of two nucleic acid sequences) is determined using the algorithm of Karlin and Altschul (PNAS USA 87:2264-2268, 1990), modified as in Karlin and Altschul, PNAS USA 90:5873-5877, 1993). Such an algorithm is incorporated into the NBLAST and XBLAST programs of Altschul et al. (J. Mol. Biol. 215:403-410, 1990). BLAST nucleotide searches are performed with the NBLAST program, score=100, wordlength=12. BLAST protein searches are performed with the XBLAST program, score=50, wordlength=3. To obtain gapped alignment for comparison purposes GappedBLAST is utilized as described in Altschul et al. (Nucleic Acids Res. 25:3389-3402, 1997). When utilizing BLAST and GappedBLAST programs the default parameters of the respective programs (e.g., XBLAST and NBLAST) are used to obtain nucleotide sequences homologous to a nucleic acid molecule of the invention.

Identity or identical means amino acid sequence similarity and has an art recognized meaning. Sequences with identity share identical or similar amino acids. Thus, a candidate sequence sharing 85% amino acid sequence identity with a reference sequence requires that, following alignment of the candidate sequence with the reference sequence, 85% of the amino acids in the candidate sequence are identical to the corresponding amino acids in the reference sequence, and/or constitute conservative amino acid changes.

Functionally active variants of SEQ ID NOs:167-226, 228-261, and 263-354 retain substantially the same functional activity of the original polypeptide or fragment. Naturally occurring functionally active variants such as allelic variants and species variants and non-naturally occurring functionally active variants are included in the invention and can be produced by, for example, mutagenesis techniques or by direct synthesis.

A functionally active variant differs by about, for example, 1, 2, 3, 4, 5, 6, 7, 8, 9, 10, 20 50, or 100 amino acid residues from a polypeptide shown in SEQ ID NOs:167-226, 228-261, and 263-354 or a fragment thereof. Where this comparison requires alignment the sequences are aligned for maximum homology. The site of variation can occur anywhere in the polypeptide, as long as activity substantially similar to a polypeptide shown in SEQ ID NOs:167-226, 228-261, and 263-354 are maintained within the functionally active variant.

Guidance concerning how to make phenotypically silent amino acid substitutions is provided in Bowie et al., Science, 247:1306-1310 (1990), which teaches that there are two main strategies for studying the tolerance of an amino acid sequence to change.

The first strategy exploits the tolerance of amino acid substitutions by natural selection during the process of evolution. By comparing amino acid sequences in different species, the amino acid positions which have been conserved between species can be identified. These conserved amino acids are likely important for protein function. In contrast, the amino acid positions in which substitutions have been tolerated by natural selection indicate positions which are not critical for protein function. Thus, positions tolerating amino acid substitution can be modified while still maintaining specific binding activity of the polypeptide.

The second strategy uses genetic engineering to introduce amino acid changes at specific positions of a cloned gene to identify regions critical for protein function. For example, site-directed mutagenesis or alanine-scanning mutagenesis (the introduction of single alanine mutations at every residue in the molecule) can be used (Cunningham et al., Science, 244:1081-1085 (1989)). The resulting variant molecules can then be tested for specific binding to antibodies of the invention.

According to Bowie et al., these two strategies have revealed that proteins are surprisingly tolerant of amino acid substitutions. The authors further indicate which amino acid changes are likely to be permissive at certain amino acid positions in the protein. For example, the most buried or interior (within the tertiary structure of the protein) amino acid residues require nonpolar side chains, whereas few features of surface or exterior side chains are generally conserved.

Methods of introducing a mutation into amino acids of a protein is well known to those skilled in the art. See, e.g., Ausubel (ed.), Current Protocols in Molecular Biology, John Wiley and Sons, Inc. (1994); T. Maniatis, E. F. Fritsch and J. Sambrook, Molecular Cloning: A Laboratory Manual, Cold Spring Harbor laboratory, Cold Spring Harbor, N.Y. (1989)). Mutations can also be introduced using commercially available kits such as "QuikChange™ Site-Directed Mutagenesis Kit" (Stratagene). The generation of a functionally active variant of a polypeptide by replacing an amino acid that does not influence the function of a polypeptide can be accomplished by one skilled in the art.

A polypeptide of the invention can be isolated from cell sources using standard protein purification techniques. Polypeptides of the invention can also be synthesized chemically or produced by recombinant DNA techniques. For example, a polypeptide of the invention can be synthesized using conventional peptide synthesizers. Additionally, a polynucleotide encoding a polypeptide of the invention can be introduced into an expression vector that can be expressed in a suitable expression system using techniques well known in the art. A variety of bacterial, yeast, plant, mammalian, and insect expression systems are available in the art and any such expression system can be used. Optionally, a polynucleotide encoding a polypeptide of the invention can be translated in a cell-free translation system.

A functionally active variant polypeptide can be also isolated using a hybridization technique. Briefly, DNA having a high homology to the whole or part of a nucleic acid sequence encoding SEQ ID NOs:167-226, 228-261, and 263-354 is used to prepare a functionally active polypeptide. Therefore, a polypeptide of the invention also includes polypeptides that are functionally equivalent to a SEQ ID NOs:167-226, 228-261, and 263-354 and are encoded by a nucleic acid molecule that hybridizes with a nucleic acid encoding SEQ ID NOs: 167-226, 228-261, and 263-354 or a complement thereof. One of skill in the art can easily determine nucleic acid sequences that encode polypeptides of the invention using readily available codon tables. As such, these nucleic acid sequences are not presented herein.

The stringency of hybridization for a nucleic acid encoding a polypeptide that is a functionally active variant is, for example, 10% formamide, 5×SSPE, 1× Denhart's solution, and 1× salmon sperm DNA (low stringency conditions). More preferable conditions are, 25% formamide, 5×SSPE, 1× Denhart's solution, and 1× salmon sperm DNA (moderate stringency conditions), and even more preferable conditions are, 50% formamide, 5×SSPE, 1× Denhart's solution, and 1× salmon sperm DNA (high stringency conditions). However, several factors influence the stringency of hybridization other than the above-described formamide concentration, and one skilled in the art can suitably select these factors to accomplish a similar stringency.

Nucleic acid molecules encoding a functionally active variant polypeptide can also be isolated by a gene amplification method such as PCR using a portion of a nucleic acid molecule DNA encoding a polypeptide shown in SEQ ID NOs:167-226, 228-261, and 263-354 as the probe.

Functionally active variant polypeptides of the invention can also comprise those that arise as a result of the existence of multiple genes, alternative transcription events, alternative RNA splicing events, and alternative translational and post-translational events. A polypeptide can be expressed in systems, e.g., cultured cells, which result in substantially the same postranslational modifications present as when the polypeptide is expressed in a native cell, or in systems that result in the alteration or omission of postranslational modifications, e.g., glycosylation or cleavage, present when expressed in a native cell.

A polypeptide of the invention can be produced as a fusion protein that contains other non-Pg or non-Pg-derived amino acid sequences (i.e., heterologous polypeptides), such as amino acid linkers or signal sequences, as well as ligands useful in protein purification, such as glutathione-S-transferase, histidine tag, and staphylococcal protein A. More than one polypeptide of the invention can be present in a fusion protein. The heterologous polypeptide can be fused, for example, to the N-terminus or C-terminus of the polypeptide. A polypeptide of the invention can also comprise homologous amino acid sequences, i.e., other Pg or Pg-derived sequences.

In one embodiment of the invention, functionally active variants differ from polypeptides shown in SEQ ID NOs:167-226, 228-261, and 263-354 by only conservative amino acid substitutions, such that the antigenic properties of the polypeptide are substantially the same as the original polypeptide. These variants can generally be identified by modifying one of the polypeptide sequences of the invention, and evaluating the antigenic properties of the modified polypeptide using, for example, an immunohistochemical assay, an enzyme-linked immunosorbant assay (ELISA), a radioimmunoassay (RIA), or a western blot assay. These variants can comprise at least about 1, 5, 10, 25, 50, or 100 conservative amino acid substitutions.

A conservative amino acid substitution is one in which an amino acid is substituted for another amino acid that has similar properties, such that one skilled in the art of peptide chemistry would expect the secondary structure and hydropathic nature of the polypeptide to be substantially unchanged. In general, the following groups of amino acids represent conservative changes: (1) ala, pro, gly, glu, asp, gln, asn, ser, thr; (2) cys, ser, tyr, thr; (3) val, ile, leu, met, ala, phe; (4) lys, arg, his; and (5) phe, tyr, trp, his.

More particularly, a "conservative amino acid substitution" may involve a substitution of a native amino acid residue with a normative residue such that there is little or no effect on the polarity or charge of the amino acid residue at that position. Furthermore, any native residue in the polypeptide may also be substituted with alanine, as has been previously described for "alanine scanning mutagenesis." Conservative amino acid substitutions also encompass non-naturally occurring amino acid residues that are typically incorporated by chemical peptide synthesis rather than by synthesis in biological systems. These include peptidomimetics, and other reversed or inverted forms of amino acid moieties.

Naturally occurring residues may be divided into classes based on common side chain properties:

1) hydrophobic: norleucine, Met, Ala, Val, Leu, Ile;
2) neutral hydrophilic: Cys, Ser, Thr;
3) acidic: Asp, Glu;
4) basic: Asn, Gln, His, Lys, Arg;
5) residues that influence chain orientation: Gly, Pro; and
6) aromatic: Trp, Tyr, Phe.

For example, non-conservative substitutions may involve the exchange of a member of one of these classes for a member from another class.

In making such changes, the hydropathic index of amino acids may be considered. Each amino acid has been assigned a hydropathic index on the basis of its hydrophobicity and charge characteristics. The hydropathic indices are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

The importance of the hydropathic amino acid index in conferring interactive biological function on a protein is generally understood in the art (Kyte et al., 1982, *J. Mol. Biol.* 157:105-31). It is known that certain amino acids may be substituted for other amino acids having a similar hydropathic index or score and still retain a similar biological activity. In making changes based upon the hydropathic index, the substitution of amino acids whose hydropathic indices are within ±2 is preferred, those within ±1 are particularly preferred, and those within ±0.5 are even more particularly preferred.

It is also understood in the art that the substitution of like amino acids can be made effectively on the basis of hydrophilicity, particularly where the biologically functionally equivalent protein or peptide thereby created is intended for use in immunological embodiments, as in the present case. The greatest local average hydrophilicity of a protein, as governed by the hydrophilicity of its adjacent amino acids, correlates with its immunogenicity and antigenicity, i.e., with a biological property of the protein.

The following hydrophilicity values have been assigned to these amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); and tryptophan (−3.4). In making changes based upon similar hydrophilicity values, the substitution of amino acids whose hydrophilicity values are within ±2 is preferred, those within ±1 are particularly preferred, and those within ±0.5 are even more particularly preferred. One may also identify epitopes from primary amino acid sequences on the basis of hydrophilicity. These regions are also referred to as "epitopic core regions."

Desired amino acid substitutions (whether conservative or non-conservative) can be determined by those skilled in the art at the time such substitutions are desired. Exemplary amino acid substitutions are set forth in Table 1.

TABLE 1

| Original Residues | Exemplary Substitutions | Preferred Substitutions |
|---|---|---|
| Ala | Val, Leu, Ile | Val |
| Arg | Lys, Gln, Asn | Lys |
| Asn | Gln | Gln |
| Asp | Glu | Glu |
| Cys | Ser, Ala | Ser |
| Gln | Asn | Asn |
| Glu | Asp | Asp |
| Gly | Pro, Ala | Ala |
| His | Asn, Gln, Lys, Arg | Arg |
| Ile | Leu, Val, Met, Ala, Phe, Norleucine | Leu |
| Leu | Norleucine, Ile, Val, Met, Ala, Phe | Ile |
| Lys | Arg, 1,4 Diamino-butyric Acid, Gln, Asn | Arg |
| Met | Leu, Phe, Ile | Leu |
| Phe | Leu, Val, Ile, Ala,, Tyr | Leu |
| Pro | Ala | Gly |
| Ser | Thr, Ala, Cys | Thr |
| Thr | Ser | Ser |
| Trp | Tyr, Phe | Tyr |
| Tyr | Trp, Phe, Thr, Ser | Phe |
| Val | Ile, Met, Leu, Phe, Ala, Norleucine | Leu |

Polypeptides of the invention can be antigens that are recognized by an antibody reactive against Pg. The antigen can comprise one or more epitopes (or antigenic determinants). An epitope can be a linear epitope, sequential epitope or a conformational epitope. Epitopes within a polypeptide of the invention can be identified by several methods. See, e.g., U.S. Pat. No. 4,554,101; Jameson & Wolf, *CABIOS* 4:181-186 (1988). For example, a polypeptide of the invention can be isolated and screened. A series of short peptides, which together span an entire polypeptide sequence, can be prepared by proteolytic cleavage. By starting with, for example, 100-mer polypeptide fragments, each fragment can be tested for the presence of epitopes recognized in an ELISA. For example, in an ELISA assay a Pg polypeptide, such as a 100-mer polypeptide fragment, is attached to a solid support, such as the wells of a plastic multi-well plate. A population of antibodies are labeled, added to the solid support and allowed to bind to the unlabeled antigen, under conditions where non-specific adsorbtion is blocked, and any unbound antibody and other proteins are washed away. Antibody binding is detected by, for example, a reaction that converts a colorless substrate into a colored reaction product. Progressively smaller and overlapping fragments can then be tested from an identified 100-mer to map the epitope of interest.

Polynucleotides

Polynucleotides of the invention contain less than an entire genome and can be RNA or single- or double-stranded DNA or combinations or modifications thereof. The polynucleotides can be isolated free of other components, such as proteins and lipids. An isolated polynucleotide is substantially purified away from other polynucleotides and biological molecules. Preferably, a polynucleotide is greater than 60%, 70%, 80%, 90%, 95%, 98%, 99%, 99.5% or more purified from other polynucleotides and/or biological molecules. The polynucleotides of the invention encode the polypeptides described above, as well as fragments thereof. Polynucleotides of the invention also include those shown in SEQ ID NO:1-166, 227, and 262 and fragments thereof. These polynucleotides will be referred to as the "polynucleotide SEQ IDs."

One of skill in the art can obtain a polynucleotide sequence of the invention using a disclosed polypeptide sequence of the invention and codon tables. Polynucleotides can contain naturally occurring polynucleotides or sequences that differ from those of any naturally occurring sequences or polynucleotides. Polynucleotides of the invention can differ from naturally occurring nucleic acids, but still encode naturally occurring amino acids due to the degeneracy of the genetic code. These polynucleotides are degenerate variants and one of skill in the art could determine the sequences of all degenerate variant polynucleotides that encode SEQ ID NOs:167-226, 228-261, and 263-354. As such, these sequences are not presented herein. Polynucleotides of the invention can also comprise other heterologous nucleotide sequences (i.e., heterologous polynucleotides), such as sequences coding for linkers, signal sequences, heterologous signal sequences, TMR stop transfer sequences, transmembrane domains, or ligands useful in protein purification such as glutathione-S-transferase, histidine tag, and staphylococcal protein A. Polynucleotides of the invention can also comprise other homologous nucleotide sequences, i.e., other Pg or Pg-derived sequences.

An isolated polynucleotide is a nucleic acid molecule that is not immediately contiguous with 5' and 3' flanking sequences with which it is normally contiguous when present in a naturally occurring genome. Therefore, an isolated polynucleotide can be, for example, a polynucleotide that is incorporated into a vector, such as a plasmid or viral vector, a polynucleotide that is incorporated into the genome of a heterologous cell (or the genome of a homologous cell, but at a site different from that where it naturally occurs) and a polynucleotide that exists as a separate molecule such as a polynucleotide produced by PCR amplification, chemical synthesis, restriction enzyme digestion, or in vitro transcription. An isolated polynucleotide is also a nucleic acid molecule, such as a recombinant nucleic acid molecule that forms part of a hybrid polynucleotide encoding additional polypeptide sequences that can be used for example, in the production of a fusion protein.

Degenerate nucleotide sequences encoding polypeptides of the invention, as well as homologous variant nucleotide sequences that are at least about 75, or about 90, 96, 98, or 99% identical to the nucleotide sequences shown in the polynucleotide SEQ IDs and the complements thereof are also included in the invention. Percent sequence identity can be calculated as described in the "Polypeptides" section. Degenerate nucleotide sequences are polynucleotides that encode a polypeptide shown in the polypeptide SEQ IDs or fragments thereof, but differ in nucleic acid sequence from the sequence given in the polynucleotide SEQ IDs or nucleic acid sequences occurring in nature, due to the degeneracy of the genetic code. Complementary DNA (cDNA) molecules of Pg polynucleotides that encode biologically functional Pg polypeptides also are Pg polynucleotides. A polynucleotide of the invention can comprise about at least 5, 10, 15, 50, 100, 200, 250, 300, 400, 500, or 600 contiguous nucleotides of a nucleic acid sequence shown in the polynucleotide SEQ IDs.

Polynucleotides of the invention can be isolated from nucleic acid sequences present in, for example, a biological sample, such as plaque, saliva, crevicular fluid, sputum, blood, serum, plasma, urine, feces, cerebrospinal fluid, amniotic fluid, wound exudate, or tissue, from an infected individual. Polynucleotides can also be synthesized in the laboratory, for example, using an automatic synthesizer. An amplification method such as PCR can be used to amplify polynucleotides from either genomic DNA or cDNA encoding the polypeptides.

A polynucleotide can also comprise one or more expression control sequences such as promoters, origins of replication, or enhancers, for example. A polynucleotide of the invention can be present in a vector, such as, for example, an expression vector. If desired, polynucleotides can be cloned into an expression vector comprising, for example, origins of replication, promoters, enhancers, or other expression control sequences that drive expression of the polynucleotides of the invention in host cells. The polynucleotides can be operably linked to the expression control sequences. That is, linked such that the expression control sequences drive expression of the polynucleotides. An expression vector can be, for example, a plasmid, such as pBR322, pUC, or ColE1, or an adenovirus vector, such as an adenovirus Type 2 vector or Type 5 vector. Optionally, other vectors can be used, including but not limited to Sindbis virus, simian virus 40, alphavirus vectors, poxvirus vectors, and cytomegalovirus and retroviral vectors, such as murine sarcoma virus, mouse mammary tumor virus, Moloney murine leukemia virus, and Rous sarcoma virus. Vectors suitable for use in the present invention include, for example, bacterial vectors, mammalian vectors, viral vectors (such as retroviral, adenoviral, adeno-associated viral, herpes virus, simian virus 40 (SV40), and bovine papilloma virus vectors) and baculovirus-derived vectors for use in insect cells. Minichromosomes such as MC and MC1, bacteriophages, phagemids, yeast artificial chromosomes, bacterial artificial chromosomes, virus particles, virus-like particles, cosmids (plasmids into which phage lambda cos sites have been inserted) and replicons (genetic elements that are capable of replication under their own control in a cell) can also be used. Polynucleotides in such vectors can be operably linked to a promoter, which is selected based on, e.g., the cell type in which expression is sought. Methods for preparing polynucleotides operably linked to an expression control sequence and expressing them in a host cell are well-known in the art. See, e.g., U.S. Pat. No. 4,366,246.

Host cells into which vectors, such as expression vectors, comprising polynucleotides of the invention can be introduced include, for example, prokaryotic cells (e.g., bacterial cells) and eukaryotic cells (e.g., yeast cells; insect cells; and mammalian cells). Such host cells are available from a number of different sources that are known to those skilled in the art, e.g., the American Type Culture Collection (ATCC), Rockville, Md. Host cells into which the polynucleotides of the invention have been introduced, as well as their progeny, even if not identical to the parental cells, due to mutations, are included in the invention.

Methods for introducing polynucleotides of the invention (e.g., vectors comprising the polynucleotides or naked polynucleotides) into cells (e.g., bacterial, yeast, insect or mammalian cells), either transiently or stably, are well known in the art. For example, transformation methods using standard $CaCl_2$, $MgCl_2$, or RbCl methods, protoplast fusion methods or transfection of naked or encapsulated nucleic acids using calcium phosphate precipitation, cellular fusion, microinjection, viral infection, and electroporation.

Isolation and purification of polypeptides produced in the systems described above can be carried out using conventional methods, appropriate for the particular system. For example, preparative chromatography and immunological separations employing antibodies, such as monoclonal or polyclonal antibodies, can be used.

Polynucleotides can be synthesized in the laboratory, for example, using an automatic synthesizer. An amplification method such as PCR can be used to amplify polynucleotides from either genomic DNA or cDNA encoding the polypeptides.

Antibodies

Antibodies, such as monoclonal and polyclonal antibodies, antibody fragments, and single-chain antibodies that specifically bind to polypeptides of the invention are part of the invention. An antibody and antigen (e.g., a polypeptide or polypeptide fragment of the invention) specifically bind to each other if they bind to each other with greater affinity than to other, non-specific molecules. For example, an antibody raised against an antigen to which it binds more efficiently than to a non-specific protein can be described as specifically binding to the antigen.

An antibody is said to be "directed against" a molecule if it is capable of specifically reacting with the molecule and specifically binding the molecule. An epitope refers to that portion of any molecule capable of being bound by an antibody which can also be recognized by that antibody. Epitopes or "antigenic determinants" usually consist of chemically active surface groupings of molecules such as amino acids or sugar side chains and have specific three-dimensional structural characteristics as well as specific charge characteristics.

Polypeptides of the invention comprise at least one epitope. An epitope is an antigenic determinant of a polypeptide. Epitopes within a polypeptide of the invention can be identified by several methods. See, e.g., U.S. Pat. No. 4,554,101; Jameson & Wolf, *CABIOS* 4:181-186 (1988) and "Polypeptide" section above.

An antibody is an intact immunoglobulin molecule, a fragment of an immunoglobulin molecule, or a single-chain antibody that specifically binds to a polypeptide of the invention (e.g., SEQ ID NOs:167-226, 228-261, and 263-354 and/or fragments thereof). An antibody of the invention can be any antibody class, including for example, IgG, IgM, IgA, IgD and IgE.

Antibodies of the invention can be chimeric (see, e.g., U.S. Pat. No. 5,482,856), humanized (see, e.g., Jones et al., *Nature* 321:522 (1986); Reichmann et al., *Nature* 332:323 (1988); Presta, *Curr. Op. Struct. Biol.* 2:593 (1992)), or human antibodies. Human antibodies can be made by, for example, direct immortalization, phage display, transgenic mice, or a Trimera methodology, see e.g., Reisener et al., *Trends Biotechnol.* 16:242-246 (1998).

Antibody fragments of the invention retain some ability to selectively bind to the antigen (e.g., a polypeptide of the invention) from which they are derived, and can be made using well known methods in the art. In one embodiment of the invention, an antibody, antibody fragment or single-chain antibody comprises all such antibodies that specifically bind to a polypeptide of the invention (e.g., SEQ ID NOs:167-226, 228-261, and 263-354 and/or fragments thereof). Fragments of antibodies are a portion of an intact antibody comprising the antigen binding site or variable region of an intact antibody, wherein the portion is free of the constant heavy chain domains of the Fc region of the intact antibody. Examples of antibody fragments include Fab, Fab', Fab'-SH and F(ab')$_2$ fragments.

Antigens that can be used in producing antibodies of the invention include polypeptides and polypeptide fragments of the invention. Antibodies of the invention can be made, for example, by using a polypeptide or a polypeptide fragment that contains an epitope present in a polypeptide shown in SEQ ID NOs:167-226, 228-261, and 263-354 as an immunogen in standard antibody production methods (see e.g., Kohler et al., Nature, 256:495, 1975; Ausubel et al. (1992) Current Protocols in Molecular Biology, John Wylie and Sons, Inc. New York, N.Y.; Harlow and Lane, Eds, (1988) Current Edition, Antibodies: A Laboratory Manual, Cold Spring Harbor Press, N.Y). A polypeptide used to immunize an animal can be obtained by standard recombinant, chemical synthetic, or purification methods. As is well known in the art, in order to increase immunogenicity, an antigen can be conjugated to a carrier protein. Commonly used carriers include keyhole limpet hemocyanin (KLH), thyroglobulin, bovine serum albumin (BSA), and tetanus toxoid. The coupled peptide is then used to immunize an animal (e.g., a mouse, a rat, or a rabbit). In addition to such carriers, well known adjuvants can be administered with the antigen to facilitate induction of a strong immune response.

An antibody can be made in vivo in suitable laboratory animals or in vitro using recombinant DNA techniques. Means for preparing and characterizing antibodies are well know in the art. See, e.g., Dean, *Methods Mol. Biol.* 80:23-37 (1998); Dean, *Methods Mol. Biol.* 32:361-79 (1994); Baileg, *Methods Mol. Biol.* 32:381-88 (1994); Gullick, *Methods Mol. Biol.* 32:389-99 (1994); Drenckhahn et al. *Methods Cell. Biol.* 37:7-56 (1993); Morrison, *Ann. Rev. Immunol.* 10:239-65 (1992); Wright et al. *Crit. Rev. Immunol.* 12:125-68 (1992). For example, polyclonal antibodies can be produced by administering a polypeptide of the invention to an animal, such as a human or other primate, mouse, rat, rabbit, guinea pig, goat, pig, cow, sheep, donkey, or horse. Serum from the immunized animal is collected and the antibodies are purified from the plasma by, for example, precipitation with ammonium sulfate, followed by chromatography, such as affinity chromatography. Techniques for producing and processing polyclonal antibodies are known in the art.

Monoclonal antibodies directed against epitopes present on a polypeptide of the invention can also be readily produced. For example, normal B cells from a mammal, such as a mouse, which was immunized with a polypeptide of the invention can be fused with, for example, HAT-sensitive mouse myeloma cells to produce hybridomas. Hybridomas producing Pg-specific antibodies can be identified using RIA or ELISA and isolated by cloning in semi-solid agar or by limiting dilution. Clones producing Pg-specific antibodies are isolated by another round of screening. Monoclonal antibodies can be screened for specificity using standard techniques, for example, by binding a polypeptide of the invention to a microtiter plate and measuring binding of the monoclonal antibody by an ELISA assay. Techniques for producing and processing monoclonal antibodies are known in the art. See e.g., Kohler & Milstein, Nature, 256:495 (1975). Particular isotypes of a monoclonal antibody can be prepared directly, by selecting from the initial fusion, or prepared secondarily, from a parental hybridoma secreting a monoclonal antibody of a different isotype by using a sib selection technique to isolate class-switch variants. See Steplewski et al., *P.N.A.S. U.S.A.* 82:8653 1985; Spria et al., *J. Immunolog. Meth.* 74:307, 1984. Monoclonal antibodies of the invention can also be recombinant monoclonal antibodies. See, e.g., U.S. Pat. No. 4,474,893; U.S. Pat. No. 4,816,567. Antibodies of the invention can also be chemically constructed. See, e.g., U.S. Pat. No. 4,676,980.

Polyclonal and monoclonal antibodies can be purified, for example, by binding to, and elution from, a matrix containing a polypeptide or polypeptide fragment of the invention to which the antibodies were raised. Additional methods for antibody purification and concentration are well known in the art and can be practiced with the antibodies of the invention. Anti-idiotype antibodies corresponding to polypeptides of the invention are also included in the invention, and can be produced using standard methods.

Antibodies, antibody fragments, and single-chain antibodies of the invention can further be used to isolate Pg organisms or Pg antigens by immunoaffinity columns. The antibodies can be affixed to a solid support by, for example, adsorbtion or by covalent linkage so that the antibodies retain their immunoselective activity. Optionally, spacer groups can be included so that the antigen binding site of the antibody remains accessible. The immobilized antibodies can then be used to bind Pg organisms or Pg antigens from a sample, such as a biological sample including saliva, plaque, crevicular fluid, sputum, blood, urine, feces, cerebrospinal fluid, amniotic fluid, wound exudate, or tissue. The bound Pg organisms or Pg antigens are recovered from the column matrix by, for example, a change in pH.

Antibodies of the invention can also be used in immunolocalization studies to analyze the presence and distribution of a polypeptide of the invention during various cellular events or physiological conditions. Antibodies can also be used to identify molecules involved in passive immunization and to identify molecules involved in the biosynthesis of non-protein antigens. Identification of such molecules can be useful in vaccine development. Antibodies of the invention, including, for example, monoclonal antibodies and single-chain antibodies, can be used to monitor the course of amelioration of a disease caused by Pg. By measuring the increase or decrease of Pg antibodies to Pg proteins in a test sample from an animal, it can be determined whether a particular therapeutic regimen aimed at ameliorating the disorder is effective. Antibodies can be detected and/or quantified using for example, direct binding assays such as RIA, ELISA, or western blot assays.

Aptamers of the Invention

An aptamer is a nucleic acid molecule (e.g., DNA or RNA or analogs thereof) that is capable of binding to a particular target molecule (e.g., a protein or polypeptide) with high affinity and specificity. See e.g., Tuerk and Gold, Science 249:505 (1990), Ellington and Szostak, Nature, 346:818 (1990).

Aptamers can bind protein targets and disrupt the interactions of the protein target with other proteins and/or disrupt catalysis by the protein targets. See e.g., Blind et al., Proc. Natl. Acad. Sci., 96:3606-3610 (1999); U.S. Pat. No. 5,756, 291; U.S. Pat. No. 5,840,867; Osborne et al., Curr. Opin. Chem. Biol. 1:5-9 (1997).

Aptamers of the invention have specific binding regions that form complexes with a polypeptide shown in SEQ ID NOs:167-226, 228-261, and 263-354 and/or fragments thereof under conditions where other non-specific substances are not complexed with the aptamer. Aptamers of the invention can also complex with a protein comprising SEQ ID NOs:167-226, 228-261, and 263-354 and/or fragments thereof under conditions where other non-specific substances are not complexed with the aptamer. The specificity of binding is defined in terms of comparative dissociation constants (Kd) of an aptamer for its ligand (in this case SEQ ID NOs: 167-226, 228-261, and 263-354 and/or fragments thereof) as compared to the dissociation constant of the aptamer for other non-specific substances. Typically, the Kd of an aptamer for its ligand is about 10-fold less that the Kd for the aptamer for non-specific substances. In other embodiments, the Kd is about 50-fold, 100-fold, or 200-fold less that the Kd for the aptamer for non-specific substances. An aptamer can be, for example, 10, 20, 50, 100, 150, 200, 300, 400, or 500 nucleotides in length.

Aptamers can be identified for a specific polypeptide or protein target using for, example, selective evolution of ligands by exponential enrichment (SELEX) methods. See e.g., Wilson and Szoztak, Ann. Rev. Biochem. 68:611-647 (1999); Sun, Curr. Opin. Mol. Ther. 2:100-5 (2000); U.S. Pat. No. 5,861,254; U.S. Pat. No. 5,475,096; U.S. Pat. No. 5,595, 877; U.S. Pat. No. 5,660,985; see also, U.S. Pat. No. 6,180, 348; Bock et al., Nature, 355:564-566 (1990); Conrad et al., Methods in Enzymol., 267:336-367 (1996).

Methods of Diagnosis or Pg Infection and Detection of Pg

Antibodies, antibody fragments, single-chain antibodies, polypeptides and polynucleotides of the invention can be used to detect Pg organisms, Pg polynucleotides, Pg polypeptides, and Pg-specific antibodies in a test sample, such as a biological sample.

A biological sample can be, for example, plaque, saliva, crevicular fluid, sputum, blood, serum, plasma, urine, feces, cerebrospinal fluid, amniotic fluid, wound exudates or tissue.

An antibody, antibody fragment, or single-chain antibody of the invention can be used to detect Pg infection, the presence of Pg polypeptides or fragments thereof, and/or Pg organisms by contacting a test sample suspected of containing a Pg polypeptide, fragment thereof, or Pg organisms (i.e., antigens) with an antibody of the invention under conditions enabling the formation of an antibody-antigen complex (i.e., an immunocomplex). The amount of antibody-antigen complexes can be determined by methodology known in the art. A level that is higher than that formed in a control sample indicates a Pg infection and/or the presence of a Pg polypeptide, fragment thereof, and/or Pg organism in the test sample.

Methods of detection of an antigen in test sample using an antibody, antibody fragment, or single-chain antibody are well known in the art and any such method can be used. Antibodies of the invention can be used in vitro or in vivo for immunodiagnosis. The antibodies are suited for use in, for example, immunoassays in which they are in liquid phase or bound to a solid phase carrier. Antibodies, fragments thereof, and/or single-chain antibodies of the invention can be bound to a support and used to detect the presence of Pg or a Pg antigen. Supports include, for example, glass, polystyrene, polypropylene, polyethylene, dextran, nylon, amylases, natural and modified celluloses, polyacrylamides, agaroses and magletite.

The antibodies used in such immunoassays can be detectably labeled (e.g., with an enzyme, a radioisotope, a fluorescent compound, a colloidal metal, a chemiluminescent compound, a phosphorescent compound, or a bioluminescent compound) using any of several standard methods that are well known in the art. Alternatively, the antibodies can be unlabeled. Examples of immunoassays in which the antibodies of the invention can be used include, e.g., competitive and non-competitive immunoassays, which are carried out using either direct or indirect formats. Examples of such immunoassays include radioimmunoassays (RIA) and sandwich assays (e.g., enzyme-linked immunosorbent assays (ELISAs)). Detection of Pg polypeptides using antibodies of the invention can be done using immunoassays that are run in either forward, reverse, or simultaneous modes, including immunohistochemical assays on physiological samples. Other immunoassay formats are well known in the art, and can be used in the invention.

An immunoassay can utilize one antibody or several antibodies. An immunoassay can use, for example, a monoclonal antibody directed towards a Pg epitope, a combination of monoclonal antibodies directed towards epitopes of one Pg polypeptide, monoclonal antibodies directed towards epitopes of different Pg polypeptides, polyclonal antibodies directed towards the same Pg antigen, polyclonal antibodies directed towards different Pg antigens, or a combination of monoclonal and polyclonal antibodies.

An antibody of the invention can be used in a method of the diagnosis of Pg infection by obtaining a test sample from an animal suspected of having a Pg infection. The test sample is contacted with an antibody of the invention under conditions enabling the formation of an antibody-antigen complex (i.e., an immunocomplex). The presence and/or amount of antibody-antigen complexes can be determined by methodology known in the art. The presence of complexes and/or a level of complexes that is higher than that formed in a control sample indicates a Pg infection.

One embodiment of the invention provides methods of detecting the presence of Pg or a Pg polypeptide in a test sample. The methods comprise contacting a test sample with an antibody, antibody fragment, or single-chain antibody of the invention that specifically binds Pg or a Pg polypeptide under conditions that allow formation of an immunocomplex between the antibody, antibody fragment, or single-chain antibody and the Pg or the Pg polypeptide. Detection of an immunocomplex indicates the presence of Pg or a Pg polypeptide in the test sample. The detected Pg polypeptide can be expressed in vivo during infection of an animal.

Another embodiment of the invention provides methods for detecting Pg infection in a subject. The methods comprise obtaining a biological sample from a subject and contacting the biological sample with an immunogenic polypeptide comprising at least about 5 contiguous amino acids of an amino acid sequence selected from the group consisting of SEQ ID NOs:167-226, 228-261, and 263-354 under conditions that allow formation of the immunocomplexes between the polypeptide and Pg antibodies present in the biological sample. Immunocomplexes are detected. The detection of immunocomplexes indicates a Pg infection in the subject. Alternatively or additionally the amount of immunocomplexes can be detected and the amount of immunocomplexes formed is compared to a control sample. A higher amount of immunocomplexes in the biological sample than the control sample indicates a Pg infection in the subject. Additionally, the isotype or isotypes of antibodies present in immunocomplexes or the ratios of isotypes present in immunocomplexes as compared to controls can be used to indicate Pg infection.

Another embodiment of the invention provides methods for detecting Pg in a subject. The methods comprise obtaining a biological sample from the subject and contacting the biological sample with an antibody, antibody fragment, or single-chain antibody of the invention under conditions that allow formation of immunocomplexes between the antibody, antibody fragment, or single-chain antibody and Pg polypeptides present in the biological sample. Immunocomplexes are detected. The detection of immunocomplexes indicates a Pg infection in the subject. Alternatively or additionally the amount of immunocomplexes is detected. The amount of immunocomplexes formed is compared to a control sample. A higher amount of immunocomplexes in the biological sample than in the control sample indicates a Pg infection in the subject.

In another embodiment of the invention, a polypeptide or fragment thereof of the invention can be used in a method of detecting Pg infection or the presence of antibodies or antibody fragments specific for Pg by contacting a test sample suspected of containing a Pg antibody or antibody fragment with a polypeptide or fragment thereof (i.e., an antigen) of the invention under conditions enabling the formation of an antibody-antigen complex (i.e., an immunocomplex). The polypeptide or fragment can be labeled or unlabeled. The presence of antibody-antigen complexes can be determined by methodology known in the art. Detection of the immunocomplex indicates the presence of a Pg antibody or Pg antibody fragment in a test sample. A control reaction can also be completed, wherein a level of immunocomplexes in a test sample that is higher than that formed in a control sample indicates a Pg infection or the presence of antibodies specific for Pg in the test sample. The same methodologies and techniques described above for the detection of polypeptides can be used to detect Pg antibodies.

Polynucleotides and fragments thereof the invention can be used, for example, as probes or primers, for example PCR primers, to detect the presence of Pg polynucleotides in a test sample, such as a biological sample. The ability of such probes and primers to specifically hybridize to Pg polynucleotide sequences will enable them to be of use in detecting the presence of complementary sequences in a given sample. Polynucleotides from the sample can be, for example, subjected to gel electrophoresis or other size separation techniques or can be immobilized without size separation. The polynucleotide probes or primers can be labeled or unlabeled. Suitable labels, and methods for labeling probes and primers are known in the art, and include, for example, radioactive labels incorporated by nick translation or by kinase, biotin labels, fluorescent labels, chemiluminescent labels, bioluminescent labels, metal chelator labels and enzyme labels. The polynucleotides from the sample are contacted with the probes or primers under hybridization conditions of suitable stringencies.

One embodiment of the invention provides methods of detecting the presence of a first Pg polynucleotide in a test sample. The methods comprise contacting a test sample suspected of containing the first polynucleotide with a second polynucleotide under hybridization conditions. The second polynucleotide is an isolated polynucleotide comprising a sequence that encodes an isolated immunogenic polypeptide comprising about at least 5 contiguous amino acids of an amino acid sequence selected from the group consisting of SEQ ID NOs:167-226, 228-261, and 263-354. A hybridized first and second polynucleotide complex is detected. The presence of a hybridized first and second polynucleotide complex indicates the presence of a first polynucleotide in the test sample.

One embodiment of the invention provides methods for detecting Pg in a subject. The methods comprise obtaining a biological sample from the subject and contacting the biological sample with the polynucleotide of the invention under conditions that allow the formation of a hybridized complex between the polynucleotide of the invention and Pg polynucleotides present in the biological sample. The amount of hybridized complexes are detected and optionally compared to a control sample. The presence of hybridized complexes or a higher amount of hybridized complexes in the biological sample than in the control sample indicates a Pg infection in the subject.

Depending on the application, varying conditions of hybridization can be used to achieve varying degrees of selectivity of the probe or primer towards the target sequence. For applications requiring high selectivity, relatively stringent conditions can be used, such as low salt and/or high temperature conditions, such as provided by a salt concentration of from about 0.02 M to about 0.15 M salt at temperatures of from about 50° C. to about 70° C. For applications requiring less selectivity, less stringent hybridization conditions can be used. For example, salt conditions from about 0.14 M to about 0.9M salt, at temperatures ranging form about 20° C. to about 55° C. The presence of a hybridized complex comprising the probe or primer and a complementary polynucleotide from the test sample indicates the presence of Pg or a Pg polynucleotide sequence in the sample.

The materials for use in a detection method of the invention can be present in a kit. A kit can comprise one or more elements used in the method. For example, a kit can contain one or more antibodies, antibody fragments, single-chain antibodies, polypeptides, or polynucleotides of the invention in one or more containers. The kit and container or containers are labeled with their contents and the kit includes instructions for use of the elements in the containers. The constituents of the kit can be present in, for example, liquid or lypholized form.

Methods of Treatment and Prevention

Diseases and symptoms in a subject caused by Pg can be treated and/or prevented in a subject by, for example, administration to or immunization of a subject with polynucleotides and/or polypeptides and/or aptamers of the invention.

Diseases caused by Pg include, for example, early-onset periodontitis including localized and generalized prepubertal periodontitis, localized and generalized juvenile periodontitis, and rapidly progressive or refractory adult periodontitis, endocarditis, thyroid gland abscesses, urinary tract infections, brain abscesses, vertebral osteomyelitis, and cardiovascular diseases.

A polypeptide, polynucleotide, antibody, antibody fragment, or single-chain antibody of the invention can be administered to a subject, for example, a mammal, such as a mouse, rabbit, guinea pig, macaque, baboon, chimpanzee, human, cow, sheep, pig, horse, dog, cat, or to animals such as chickens or ducks.

One embodiment of the invention provides a composition comprising an antibody, antibody fragment, single-chain antibody, polynucleotide or fragment thereof, polypeptide or fragment thereof and a pharmaceutically acceptable carrier.

One embodiment of the invention provides a composition for use in the treatment or prevention of periodontal diseases and symptoms in a subject, which comprises an amount, such as an immunologically effective amount, of a polypeptide of the invention (e.g., SEQ ID NOs:167-226, 228-261, and 263-354), polynucleotide of the invention, or an antibody, antibody fragment, or single-chain antibody or fragment thereof and one or more pharmaceutically acceptable carriers. Treatment is the reduction, amelioration, or elimination of one or more periodontal disease symptoms.

An immunologically effective amount is an amount sufficient to stimulate the immune system, directly or indirectly. This stimulation of the immune system can confer immunity against Pg-mediated diseases, such as periodontal diseases, or symptoms thereof. An effective amount is determined the severity of the disease, age, sex and weight of the patient, as well as the patient's general condition, and by other considerations known to the attending physician.

Compositions of the invention can be used to illicit immunity to periodontal diseases and symptoms. Administration of antibodies, antibody fragments, single-chain antibodies or aptamers of the invention to a subject can provide humoral immunity. This passive immunization provides substantially immediate protection. Active immunization can be achieved by administering polypeptides, polynucleotides and/or fragments thereof of the invention to a subject.

The invention also provides compositions for use in the treatment or prevention of one or more periodontal disease symptoms comprising a therapeutically effective amount of an antibody, antibody fragment, or single-chain antibody of the invention, polynucleotide, polypeptide, or aptamer of the invention optionally with one or more pharmaceutically acceptable carriers. Such compositions can be administered to a subject for the treatment or prevention of one or more periodontal disease symptoms. A therapeutically effective amount is an amount effective in preventing or alleviating the symptoms of a disease caused by Pg or in reducing the amount of Pg organisms in a subject.

The invention also provides compositions for use in treatment or prevention of periodontal disease symptoms in a subject, which comprises an immunologically effective amount of a polypeptide shown in SEQ ID NOs:167-226, 228-261, and 263-354 or fragments thereof and, optionally one or more pharmaceutically acceptable carriers. Optionally, an adjuvant can also be present in the composition, or can be administered before or after the composition. Such compositions can be administered to a subject for the treatment or prevention of one or more periodontal disease symptoms.

The administration of one or more polypeptides of the invention can result in production of anti-Pg antibodies, resulting in a reduction in and/or prevention of periodontal diseases and symptoms thereof.

Modifications can be made to a polypeptide of the invention to increase its immunogenicity. For example, a polypeptide can be conjugated or coupled with a carrier, e.g. a Cholera toxin B chain or monoclonal antibody. The polypeptide can be precipitated with aluminum salts or cross-linked with formaldehyde or other aldehydes. The polypeptide can be mixed with a physiologically acceptable diluent such as water, phosphate buffered saline, or saline. A composition of the invention can further comprise an adjuvant.

The invention additionally provides compositions for use in the treatment or prevention or one or more periodontal disease symptoms comprising an immunologically effective amount of one or more polynucleotides shown in SEQ ID NOs:1-166, 227, and 262, one or more polynucleotides that encode one or more polypeptides shown in SEQ ID NOs:167-226, 228-261, and 263-354, or fragments thereof and, optionally, one or more pharmaceutically acceptable carriers. Such compositions can be administered to a subject for the treatment or prevention of one or more periodontal disease symptoms.

In one embodiment of the invention various polynucleotide constructs, including polynucleotides of the invention and aptamers of the invention can be used as part of a gene therapy protocol to deliver polynucleotides of the invention to a subject. For example, expression vectors can be used for in vivo transfection and expression of a polypeptide.

Injection of a polynucleotide to a subject has the practical advantages of simplicity of construction and modification. Further, injection of a polynucleotide results in the synthesis of a polypeptide in the host. Thus, the polypeptide is presented to the host immune system with native post-translational modifications, structure, and conformation. A polynucleotide can be delivered to a subject as "naked DNA."

Polypeptides or polynucleotides of the invention along with fragments thereof can be used to elicit an immune response in a host. An immunogenic polypeptide or polynucleotide is a polypeptide or polynucleotide of the invention that is capable of inducing an immune response in an animal. An immunogenic polypeptide or polynucleotide of the invention is particularly useful in sensitizing an immune system of an animal such that, as one result, an immune response is produced that ameliorates or prevents the effect of Pg infection. The elicitation of an immune response in animal model can be useful to determine, for example, optimal doses or administration routes. Elicitation of an immune response can also be used to treat, prevent, or ameliorate a disease or infection caused by Pg. An immune response includes humoral immune responses or cell mediated immune responses, or a combination thereof. An immune response can also comprise the promotion of a generalized host response, e.g., by promoting the production of defensins.

The generation of an antibody titer by an animal against Pg can be important in protection from infection and clearance of infection. Detection and/or quantification of antibody titers after delivery of a polypeptide or polynucleotide can be used to identify epitopes that are particularly effective at eliciting antibody titers. Epitopes responsible for a strong antibody response to Pg can be identified by eliciting antibodies directed against Pg polypeptides of different lengths. Antibodies elicited by a particular polypeptide epitope can then be tested using, for example, an ELISA assay to determine which polypeptides contain epitopes that are most effective at generating a strong response. Polypeptides or fusion proteins that contain these epitopes or polynucleotides encoding the epitopes can then be constructed and used to elicit a strong antibody response.

A pharmaceutically acceptable composition or formulation is in a form suitable for administration into a cell or subject. Suitable forms, in part, depend upon the use or the route of entry. Such forms should not prevent the composition or formulation from reaching a target cell or organ. For example, pharmacological compositions injected into the blood stream should be soluble. Other factors are known in the art, and include considerations such as toxicity and forms that prevent the composition or formulation from exerting its effect.

The present invention also includes pharmaceutically acceptable compositions prepared for storage or administration, which include the desired compounds in a pharmaceutically acceptable carrier, diluent, additive, excipient or adjuvant. By the terms "pharmaceutically acceptable carriers, diluents additives, excipients and adjuvants" is meant any inert, non-toxic material that can assist in the efficient delivery of the active ingredient. Acceptable carriers or diluents for therapeutic use are well known in the pharmaceutical art, and are described, for example, in *Remington's Pharmaceutical Sciences*, Mack Publishing Co. (A. R. Gennaro edit. 1985) hereby incorporated by reference herein. For example, preservatives, stabilizers, dyes and flavoring agents can be provided. These include sodium benzoate, sorbic acid and esters of p-hydroxybenzoic acid. In addition, antioxidants and suspending agents can be used.

A carrier should not itself induce the production of antibodies harmful to the host. Such carriers include, but are not limited to, large, slowly metabolized, macromolecules, such as proteins, polysaccharides such as latex functionalized sepharose, agarose, cellulose, cellulose beads and the like, polylactic acids, polyglycolic acids, polymeric amino acids such as polyglutamic acid, polylysine, and the like, amino acid copolymers, peptoids, lipitoids, and inactive, avirulent virus particles or bacterial cells. Liposomes, hydrogels, cyclodextrins, biodegradable nanocapsules, and bioadhesives can also be used as a carrier for a composition of the invention.

Pharmaceutically acceptable salts can also be used in compositions of the invention, for example, mineral salts such as hydrochlorides, hydrobromides, phosphates, or sulfates, as well as salts of organic acids such as acetates, proprionates, malonates, or benzoates. Especially useful protein substrates are serum albumins, keyhole limpet hemocyanin, immunoglobulin molecules, thyroglobulin, ovalbumin, tetanus toxoid, and other proteins well known to those of skill in the art. Compositions of the invention can also contain liquids or excipients, such as water, saline, phosphate buffered saline, Ringer's solution, Hank's solution, glucose, glycerol, dextrose, malodextrin, ethanol, or the like, singly or in combination, as well as substances such as wetting agents, emulsifying agents, tonicity adjusting agents, detergent, or pH buffering agents. Additional active agents, such as bacteriocidal agents can also be used. Polypeptides, polynucleotides, antibodies, single-chain antibodies and fragments thereof and aptamers of the invention can be delivered by numerous delivery routes.

The pharmaceutically acceptable formulations can be locally delivered by, for example, direct injection or by use of an infusion pump. Direct injection, such as subcutaneous, intramuscular, or intradermal injection, can take place using standard needle and syringe methodologies, or by needle-free technologies such as those described in Conry et al., 1999, *Clin. Cancer Res.*, 5, 2330-2337 and Barry et al., International PCT Publication No. WO 99/31262.

A polynucleotide can be directly administered, for example by injection, to a subject and expressed as a protein. The DNA or RNA can be either associated with a delivery vehicle (e.g., viruses, bacteria, liposomes, and gold beads) or naked (free from association with transfection-facilitating proteins, viral particles, liposomal formulations, charged lipids and calcium phosphate precipitating). The polynucleotide can optionally include a promoter, e.g., a viral promoter. The polypeptide encoded by the polynucleotide is produced in the subject, resulting in the generation of an immune response. Methods of delivery of polynucleotides to a host cell are described in Akhtar et al., 1992, *Trends Cell Bio.*, 2, 139; *Delivery Strategies for Antisense Oligonucleotide Therapeutics*, ed. Akhtar, 1995, Maurer et al., 1999, *Mol. Membr. Biol.*, 16, 129-140; Hofland and Huang, 1999, *Handb. Exp. Pharmacol.*, 137, 165-192; and Lee et al., 2000, *ACS Symp. Ser.*, 752, 184-192. Polynucleotides can be administered to cells by a variety of methods known to those of skill in the art, including, but not restricted to, encapsulation in liposomes, by iontophoresis, or by incorporation into other delivery vehicles, such as hydrogels, cyclodextrins, biodegradable nanocapsules, and bioadhesive microspheres, or by proteinaceous vectors (O'Hare and Normand, International PCT Publication No. WO 00/53722). Alternatively, the polynucleotide/vehicle combination is locally delivered by direct injection or by use of an infusion pump. Direct injection of the polynucleotide molecules of the invention, whether subcutaneous, intramuscular, or intradermal, can take place using standard needle and syringe methodologies, or by needle-free technologies such as those described in Conry et al., 1999, *Clin. Cancer Res.*, 5, 2330-2337 and Barry et al., International PCT Publication No. WO 99/31262. Osmotic pump (see Chun et al., 1998, *Neuroscience Letters*, 257, 135-138, D'Aldin et al., 1998, *Mol. Brain Research*, 55, 151-164, Dryden et al., 1998, *J. Endocrinol.*, 157, 169-175, Ghirnikar et al., 1998, *Neuroscience Letters*, 247, 21-24) or direct infusion (Broaddus et al., 1997, *Neurosurg. Focus*, 3, article 4) techniques can also be used. Other routes of delivery include, but are not limited to oral (tablet or pill form) and/or intrathecal delivery (Gold, 1997, *Neuroscience*, 76, 1153-1158).

Attenuated viruses or bacteria can be used in the invention by genetically-modifying an attenuated virus or bacteria so that is expresses a polypeptide of the invention. This modified vector can then be delivered to a subject, resulting in the in vivo production of the polynucleotide such that an immune response is generated in the subject. Polynucleotide molecules can be inserted into microorganisms by standard methods known in the art. See e.g., U.S. Pat. No. 5,866,136 and U.S. Pat. No. 6,025,164.

A polynucleotide of the invention can also be included in the genome of a plant, so that a polypeptide of the invention is produced by the plant. The genetically-modified plant is then consumed by a subject, resulting in the ingestion of a polypeptide of the invention and the generation of an immune response. Edible plant vaccines are described in, e.g., WO 99/54452. An edible vaccine is administered orally, e.g., consuming a genetically-modified plant. The genetically-modified plant can be in the form of a plant part, extract, juice, liquid, powder, or tablet. The edible vaccine can also be administered via an intranasal route.

Compositions of the invention can be delivered to a subject by systemic administration. Systemic administration is in vivo systemic absorption or accumulation of drugs in the blood stream followed by distribution throughout the entire body. Administration routes that can lead to systemic absorption include, without limitation: intravenous, subcutaneous, intraperitoneal, inhalation, transdermal, oral, intrapulmonary and intramuscular.

The compositions of the invention and formulations thereof can be administered orally, topically, parenterally, mucosal, by inhalation or spray, or rectally (suppository) in dosage unit formulations. The term parenteral as used herein includes percutaneous, subcutaneous, intravascular (e.g., intravenous), intradermal, intramuscular, intrapulmonary, intraperiotoneal, or intrathecal injection or infusion techniques and the like. A pharmaceutically acceptable formulation of the invention can be delivered to a subject by a liposome delivery mechanism. Standard protocols for formation of liposomes can be followed. A combination of administration methods can also be used.

Polypeptides, polynucleotides, or antibodies, or a combination thereof can be administered either to an animal that is not infected with Pg or can be administered to a Pg-infected animal.

If desired, co-stimulatory molecules, which improve immunogen presentation to lymphocytes, such as B7-1 or B7-2, or cytokines such as MIP1α, GM-CSF, IL-2, and IL-12, can be included in a composition of the invention. Optionally, adjuvants can also be included in a composition. Adjuvants are substances that can be used to nonspecifically augment a specific immune response. Generally, an adjuvant and a polypeptide of the invention are mixed prior to presentation to the immune system, or presented separately, but are presented into the same site of the animal. Adjuvants can include, for example, oil adjuvants (e.g. Freund's complete and incomplete adjuvants) mineral salts (e.g. $Alk(SO_4)_2$; $AlNa(SO_4)_2$, $AlNH_4(SO_4)$, Silica, Alum, $Al(OH)_3$, and $Ca_3(PO_4)_2$), polynucleotides (i.e. Polyic and Poly AU acids), and certain natural substances (e.g. wax D from *Mycobacteriuni tuberculosis*, as well as substances found in *Corynebacterium parvuin*, *Bordetella pertussis* and members of the genus *Brucella*. Adjuvants which can be used include, but are not limited to MF59-0, aluminum hydroxide, N-acetyl-muramyl-L-threonyl-D-isoglutamine (thr-MDP), N-acetyl-nor-muramyl-L-alanyl-D-isoglutamine (CGP 11637), referred to as nor-MDP), N-acetylmuramyl-L-alanyl-D-isoglutaminyl-L-alanine-2-(1'-2'-dipalmitoyl-sn-glycero-3-hydroxyphosphoryloxy)-ethylamine (CGP 19835A, referred to as MTP-PE), and RIBI, which contains three components extracted from bacteria, monophosphoryl lipid A, trehalose dimycolate and cell wall skeleton (MPL+TDM+CWS) in a 2% squalene/TWEEN® (polysorbate) 80 emulsion. Additional descriptions of antigenic protein-adjuvant combinations are described in WO 99/54452 and WO 99/49890.

An immunologically effective amount of a polypeptide, polynucleotide, antibody, or antibody fragment, or single-chain antibody of the invention is an amount that is delivered to a subject, either in a single dose or as part of a series, which is effective to stimulate the immune system, directly or indirectly. This amount varies depending upon the health and physical condition of the individual to be treated, the taxonomic group of individual to be treated, the capacity of the individual's immune system to synthesize antibodies, the degree of protection desired, the formulation of the vaccine, the assessment of the medical situation, and other relevant factors. It is expected that the amount will fall in a relatively broad range that can be determined through routine trials.

The pharmaceutical compositions can be in a form suitable for oral use, for example, as tablets, troches, lozenges, aqueous or oily suspensions, dispersible powders or granules, emulsion, hard or soft capsules, syrups, dentrifices, mouthwashes, gels or elixirs. Compositions intended for oral use can be prepared according to any method known to the art for the manufacture of pharmaceutical compositions and such compositions can contain one or more such sweetening agents, flavoring agents, coloring agents or preservative agents in order to provide pharmaceutically elegant and palatable preparations. Tablets contain the active ingredient or ingredients in admixture with non-toxic pharmaceutically acceptable excipients that are suitable for the manufacture of tablets. These excipients can be, for example, inert diluents; such as calcium carbonate, sodium carbonate, lactose, calcium phosphate or sodium phosphate; granulating and disintegrating agents, for example, corn starch, or alginic acid; binding agents, for example starch, gelatin or acacia; and lubricating agents, for example magnesium stearate, stearic acid or talc. The tablets can be uncoated or they can be coated by known techniques. In some cases such coatings can be prepared by known techniques to delay disintegration and absorption in the gastrointestinal tract and thereby provide a sustained action over a longer period. For example, a time delay material such as glyceryl monosterate or glyceryl distearate can be employed.

Formulations for oral use can also be presented as hard gelatin capsules wherein the active ingredient is mixed with an inert solid diluent, for example, calcium carbonate, calcium phosphate or kaolin, or as soft gelatin capsules wherein the active ingredient is mixed with water or an oil medium, for example peanut oil, liquid paraffin or olive oil.

Aqueous suspensions contain the active materials in a mixture with excipients suitable for the manufacture of aqueous suspensions. Such excipients are suspending agents, for example sodium carboxymethylcellulose, methylcellulose, hydropropyl-methylcellulose, sodium alginate, polyvinylpyrrolidone, gum tragacanth and gum acacia; dispersing or wetting agents can be a naturally-occurring phosphatide, for example, lecithin, or condensation products of an alkylene oxide with fatty acids, for example polyoxyethylene stearate, or condensation products of ethylene oxide with long chain aliphatic alcohols, for example heptadecaethyleneoxycetanol, or condensation products of ethylene oxide with partial esters derived from fatty acids and a hexitol such as polyoxyethylene sorbitol monooleate, or condensation products of ethylene oxide with partial esters derived from fatty acids and hexitol anhydrides, for example polyethylene sorbitan monooleate. The aqueous suspensions can also contain one or more preservatives, for example ethyl, or n-propyl p-hydroxybenzoate, one or more coloring agents, one or more flavoring agents, and one or more sweetening agents, such as sucrose or saccharin.

Oily suspensions can be formulated by suspending the active ingredients in a vegetable oil, for example arachis oil, olive oil, sesame oil or coconut oil, or in a mineral oil such as liquid paraffin. The oily suspensions can contain a thickening agent, for example beeswax, hard paraffin or cetyl alcohol. Sweetening agents and flavoring agents can be added to provide palatable oral preparations. These compositions can be preserved by the addition of an anti-oxidant such as ascorbic acid.

Dispersible powders and granules suitable for preparation of an aqueous suspension by the addition of water provide the active ingredient in admixture with a dispersing or wetting agent, suspending agent and one or more preservatives. Suitable dispersing or wetting agents or suspending agents are exemplified by those already mentioned above. Additional excipients, for example sweetening, flavoring and coloring agents, can also be present.

Pharmaceutical compositions of the invention can also be in the form of oil-in-water emulsions. The oily phase can be a vegetable oil or a mineral oil or mixtures of these. Suitable emulsifying agents can be naturally-occurring gums, for example gum acacia or gum tragacanth, naturally-occurring phosphatides, for example soy bean, lecithin, and esters or partial esters derived from fatty acids and hexitol, anhydrides, for example sorbitan monooleate, and condensation products of the said partial esters with ethylene oxide, for example polyoxyethylene sorbitan monooleate. The emulsions can also contain sweetening and flavoring agents.

Syrups and elixirs can be formulated with sweetening agents, for example glycerol, propylene glycol, sorbitol, glucose or sucrose. Such formulations can also contain a demulcent, a preservative and flavoring and coloring agents. The pharmaceutically acceptable compositions can be in the form of a sterile injectable aqueous or oleaginous suspension. This suspension can be formulated according to the known art using those suitable dispersing or wetting agents and suspending agents that have been mentioned above. The sterile injectable preparation can also be a sterile injectable solution or suspension in a non-toxic parentally acceptable diluent or solvent, for example as a solution in 1,3-butanediol. Among the acceptable vehicles and solvents that can be employed are water, Ringer's solution and isotonic sodium chloride solution. In addition, sterile, fixed oils are conventionally employed as a solvent or suspending medium. For this purpose, any bland fixed oil can be employed including synthetic mono- or diglycerides. In addition, fatty acids such as oleic acid find use in the preparation of injectables.

The compositions of the invention can also be administered in the form of suppositories, e.g., for rectal administration of the drugs. These compositions can be prepared by mixing the drug with a suitable non-irritating excipient that is solid at ordinary temperatures but liquid at the rectal temperature and will therefore melt in the rectum to release the drug. Such materials include cocoa butter and polyethylene glycols.

Compositions can be administered parenterally in a sterile medium. The drug, depending on the vehicle and concentration used, can either be suspended or dissolved in the vehicle. Advantageously, adjuvants such as local anesthetics, preservatives and buffering agents can be dissolved in the vehicle.

For administration to non-human animals, the composition can also be added to the animal feed or drinking water. It can be convenient to formulate the animal feed and drinking water compositions so that the animal takes in an appropriate quantity of the composition along with its diet. It can also be convenient to present the composition as a premix for addition to the feed or drinking water.

A pharmaceutically effective dose is that dose required to treat or prevent one or more Pg-induced disease symptoms in a subject. The pharmaceutically effective dose depends on the type of disease, the composition used, the route of administration, the type of subject being treated, the physical characteristics of the specific subject under consideration, age, gender, general condition of the subject, diet, concurrent medication, and other factors that those skilled in the medical arts will recognize. An effective amount of the composition of the invention can be readily determined using only routine experimentation.

A composition of the invention is administered in a manner compatible with the particular composition used and in an amount that is effective to elicit an immune response as detected by, for example, an ELISA. Antibodies and polypeptides can be administered at a daily dose of about 0.05 mg/kg to about 100 mg/kg. In one embodiment of the invention antibodies and polypeptides can be are administered at a daily dose of about 20 to about 100 mg/kg. In another embodiment antibodies and polypeptides can be administered to a subject at a dose of, for example, from about 0.05 mg/kg to about 5 mg/kg. A polypeptide of the invention can be administered at a dose of, for example. 0.01, 0.05, 0.5, 0.75, 1.0, 1.5, 2.0, 2.5, 5 or 10 mg/kg.

Administration of compositions of the invention can elicit an immune response in the animal that lasts for at least 1 week, 1 month, 3 months, 6 months, 1 year, or longer. Optionally, an immune response can be maintained in an animal by providing one or more booster administrations of the compositions of the invention at 1 month, 3 months, 6 months, 1 year, or more after the primary administration. If desired, co-stimulatory molecules or adjuvants can also be provided before, after, or together with the compositions.

All patents, patent applications, and other scientific or technical writings referred to anywhere herein are incorporated by reference in their entirety. The invention illustratively described herein suitably can be practiced in the absence of any element or elements, limitation or limitations that are not specifically disclosed herein. Thus, for example, in each instance herein any of the terms "comprising", "consisting essentially of", and "consisting of" may be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by embodiments, optional features, modification and variation of the concepts herein disclosed may be resorted to by those skilled in the art, and that such modifications and variations are considered to be within the scope of this invention as defined by the description and the appended claims.

In addition, where features or aspects of the invention are described in terms of Markush groups or other grouping of alternatives, those skilled in the art will recognize that the invention is also thereby described in terms of any individual member or subgroup of members of the Markush group or other group.

TABLE 2

| Clone Number | Locus | Name of Homologous ORF | Function | SEQ ID NO (DNA) | SEQ ID NO (amino acid) |
|---|---|---|---|---|---|
| SW 2 | 1711 | alpha-1,2-mannosidase family protein | Biosynthesis and degradation of surface polysaccharides and lipopolysaccharides | 1 | 167 |
| SW 4 | 0047 | cell division protein, FtsH, putative | Cell division | 2 | 168 |
| SW 5 | 1282 | conserved hypothetical | Unknown function | 3 | 169 |
| SW 5 | 1283 | conserved hypothetical | Unknown function | 3 | 170 |
| SW 6 | 1845, et.al. | ISPg1 transposase | Transposon functions | 4 | |
| SW 7 | 0968 | Mrr restriction system protein | DNA metabolism; Restriction/modification | 5 | 340 |
| SW 9 | 1885 | polyphosphate kinase | Central intermediary metabolism: Phosphorus compounds | 6 | 171 |
| SW 12 | 0082 | hypothetical | Unknown function | 7 | 172 |
| SW 13 | 0310 | nitroreductase family protein | Unknown function | 8 | 173 |
| SW 15 | 1908 | hypothetical | Unknown function | 9 | 174 |
| SW 18 | 1413 | hypothetical | Unknown function | 10 | 175 |
| SW 34 | 1844 | lysine-specific cysteine proteinase, authentic frameshift | Degradation of proteins, peptides, and glycopeptides | 11 | 176 |
| SW 36 | 2071 | conserved domain protein | Unknown function | 12 | 177 |
| SW 36 | 2072 | UvrD/REP helicase domain protein | Unknown function (Repair-putative) | 12 | 178 |
| SW 37 | 1888 | conserved hypothetical | Unknown function | 13 | 179 |
| SW 37 | 1889 | hypothetical | Unknown function | 13 | 180 |
| SW 41 | 0590 et al | ISPg5 transposase ORF1 | Transposon functions | 14 | 181 |
| SW 43 | 2071 | conserved domain protein | Unknown function | 15 | 182 |
| SW 43 | 2072 | UvrD/REP helicase domain protein | Unknown function (Repair-putative) | 15 | 183 |
| SW 47 | 2047 | helicase, putative | Enzymes of unknown specificity | 16 | 184 |
| SW 54 | 2216 | hypothetical | Unknown function | 17 | 185 |
| SW 56 | 2024 | arginine-specific protease ArgI polyprotein | Degradation of proteins, peptides, and glycopeptides | 18 | 186 |
| SW 57 | 2056 | transposase ISPg2-related, truncation | Transposon functions | 19 | 187 |
| SW 60 | 1545 | superoxide dismutase, Fe—Mn | Detoxification | 20 | 188 |
| SW 60 | 1546 | hypothetical | Unknown function | 20 | 189 |
| SW 61 | 0062 | TPR domain protein | Unknown function | 21 | 190 |
| SW 62 | 0944 et al | ISPg 1 transposase | Transposon functions | 22 | 191 |
| SW 64 | 1844 | lysine-specific cysteine proteinase, authentic frameshift | Degradation of proteins, peptides, and glycopeptides | 23 | 192 |
| SW 69 | 0012 | L-threonine-O-3-phosphate decarboxylase, putative | Biosynthesis of cofactors, prosthetic groups, and carriers: Heme, porphyrin, and cobalamin | 24 | 193 |
| SW 70 | 0766 | polyribonucleotide nucleotidyltransferase | Degradation of RNA | 25 | 194 |
| SW 78 | 2125 | transcriptional regulator, AraC family | Regulatory DNA interactions | 26 | 195 |
| SW 80 | 0383 | membrane-associated zinc metalloprotease, putative | Degradation of proteins, peptides, and glycopeptides | 27 | 196 |
| SW 80 | 0384 | MutS2 family protein | DNA mismatch binding protein of unknown cellular function | 27 | 197 |

TABLE 2-continued

| Clone Number | Locus | Name of Homologous ORF | Function | SEQ ID NO (DNA) | SEQ ID NO (amino acid) |
|---|---|---|---|---|---|
| SW 87 | 0293 | secretion activator protein, putative | Protein and peptide secretion and trafficking | 28 | 198 |
| SW 88 | 0383 | membrane-associated zinc metalloprotease, putative | Degradation of proteins, peptides, and glycopeptides | 29 | 199 |
| SW 88 | 0384 | MutS2 family protein | DNA mismatch binding protein of unknown cellular function | 29 | 200 |
| SW 89 | 0968 | Mrr restriction system protein | DNA metabolism; Restriction/modification | 30 | 341 |
| SW 94 | 1788 | cysteine peptidase, putative | Degradation of proteins, peptides, and glycopeptides | 31 | 201 |
| SW 99 | 1039 | integral membrane protein | Cell envelope | 32 | 202 |
| SW 100 | 0293 | secretion activator protein, putative | Protein and peptide secretion and trafficking | 33 | 203 |
| SW 101 | 0590 et al | ISPg5 transposase ORF1 | Transposon functions | 34 | 204 |
| SW 107 | 2125 | transcriptional regulator, AraC family | Regulatory DNA interactions | 35 | 205 |
| SW 112 | 0525 | CTP synthase | Pyrimidine ribonucleotide biosynthesis | 36 | 206 |
| SW 113 | 0679 | outer membrane efflux protein | Transport and binding proteins: Unknown substrate | 37 | 207 |
| SW 114 | 1021 | hypothetical | Unknown function | 38 | 208 |
| SW 114 | 1022 | hypothetical | Unknown function | 38 | 209 |
| SW 115 | 2024 | arginine-specific protease ArgI polyprotein | Degradation of proteins, peptides, and glycopeptides | 39 | 210 |
| SW 115 | 1844 | lysine-specific cysteine proteinase, authentic frameshift | Degradation of proteins, peptides, and glycopeptides | 39 | 211 |
| SW 119 | 1974 | hypothetical; P.g. 381 HagB & PgiM | Unknown function | 40 | 212 |
| SW 120 | 1334 | band7/Mec-2 family protein | Unknown function | 41 | 213 |
| SW 125 | 1880 | glycosyl transferase, group 2 family protein | Biosynthesis and degradation of surface polysaccharides and lipopolysaccharides | 42 | 214 |
| SW 127 | | | | 43 | |
| SW 129 | 2125 | transcriptional regulator, AraC family | Regulatory DNA interactions | 44 | 215 |
| SW 134 | | | | 45 | |
| SW 135 | 2115 | protease PrtT, degenerate | Degradation of proteins, peptides, and glycopeptides | 46 | |
| SW 139 | | | | 47 | |
| SW 140 | 0150 | conserved hypothetical TIGR01125 | Unknown function | 48 | 216 |
| SW 141 | 0483 | kinase, putative | Unknown function | 49 | 217 |
| SW 141 | 0484 | hypothetical | Unknown function | 49 | 218 |
| SW 142 | 2171 | D-isomer specific 2-hydroxyacid dehydrogenase family protein | Unknown function | 50 | 219 |
| SW 144 | 1680 | ABC transporter, ATP-binding protein, authentic frameshift | Transport and binding proteins: Unknown substrate | 51 | |
| SW 144 | 1681 | glycogen debranching enzyme-related protein | Unknown function | 51 | 220 |
| SW 150 | 0968 | Mrr restriction system protein | DNA metabolism; Restriction/modification | 52 | 342 |
| SW 151 | 2024 | arginine-specific protease ArgI polyprotein | Degradation of proteins, peptides, and glycopeptides | 53 | 221 |
| SW 151 | 1844 | lysine-specific cysteine proteinase, authentic frameshift | Degradation of proteins, peptides, and glycopeptides | 53 | 222 |

TABLE 2-continued

| Clone Number | Locus | Name of Homologous ORF | Function | SEQ ID NO (DNA) | SEQ ID NO (amino acid) |
|---|---|---|---|---|---|
| SW 153 | 0861 | helicase, SNF2/RAD4 family | DNA replication, recombination, and repair | 54 | 223 |
| SW 153 | 0862 | type IIS restriction endonuclease, putative | DNA replication, recombination, and repair | 54 | 224 |
| SW 159 | 0451 | CBS domain protein | Unknown function | 55 | 343 |
| SW 159 | 0452 | CBS domain protein | Unknown function | 55 | 344 |
| SW 162 | 0548 | pyruvate ferredoxin/flavodoxin oxidoreductase family protein | Energy metabolism: Electron transport | 56 | 225 |
| SW 165 | 0668 | TonB-dependent receptor | Transport and binding proteins: Cations | 57 | 226 |
| SW 165 | | partial clone | | | 227 |
| SW 166 | 2174 | hypothetical, P.g. W50 28 kDa OMP; Omp28 | Unknown function | 58 | 228 |
| SW 166 | 2175 | conserved hypothetical | Unknown function | 58 | 229 |
| SW 167 | 0712 | hypothetical | Unknown function | 59 | 230 |
| SW 169 | 0530 | carbamoyl-phosphate synthase, large subunit | Pyrimidine ribonucleotide biosynthesis | 60 | 231 |
| SW 173 | | | | 61 | |
| SW 174 | 0502 | SsrA-binding protein | Protein synthesis | 62 | 232 |
| SW 182 | 0451 | CBS domain protein | Unknown function | 63 | 345 |
| SW 182 | 0452 | CBS domain protein | Unknown function | 63 | 346 |
| SW 185 | 0285 | hypothetical | Unknown function | 64 | 233 |
| SW 200 | 1812 | 2-oxoglutarate oxidoreductase, alpha subunit | Energy metabolism: Fermentation | 65 | 234 |
| SW 203 | 0287 | hypothetical | Unknown function | 66 | 235 |
| SW 203 | 0288 | lipoprotein | Surface, Cell envelope | 66 | 236 |
| SW 208 | 1591 | conserved hypothetical | Unknown function | 67 | 237 |
| SW 210 | | | | 68 | |
| SW 214 | 0293 | secretion activator protein, putative | Protein and peptide secretion and trafficking | 69 | 238 |
| SW 223 | 2024 | arginine-specific protease ArgI polyprotein | Degradation of proteins, peptides, and glycopeptides | 70 | 239 |
| SW 248 | 2165 | glycyl-tRNA synthetase | Protein synthesis: tRNA aminoacylation | 71 | 240 |
| SW 248 | 2166 | hypothetical | Unknown function | 71 | 241 |
| SW 254 | 0114 | hypothetical | Unknown function | 72 | 242 |
| SW 259 | 0228 | DdaH family protein | Unknown function | 73 | 243 |
| SW 263 | 0292 | chromate transport protein, authentic frameshift | Transport and binding proteins: Anions | 74 | |
| SW 263 | 0293 | secretion activator protein, putative | Protein and peptide secretion and trafficking | 74 | 244 |
| SW 266 | 0026 | hypothetical | Unknown function | 75 | 245 |
| SW 267 | 2125 | transcriptional regulator, AraC family | Regulatory DNA interactions | 76 | 246 |
| SW 278 | 1889 | hypothetical | Unknown function | 77 | 247 |
| SW 279 | 1474 | conjugative transport protein TraO | Plasmid functions | 78 | 248 |
| SW 282 | 1498 | hypothetical | Unknown function | 79 | 249 |
| SW 286 | 0293 | secretion activator protein, putative | Protein and peptide secretion and trafficking | 80 | 250 |
| SW 287 | 0324 | histidine ammonia-lyase | Energy metabolism: Amino acids and amines | 81 | 251 |
| SW 287 | 0325 | conserved hypothetical | Unknown function | 81 | 252 |
| SW 290 | | | | 82 | |
| SW 300 | 1696 | type II DNA modification methyltransferase, putative | Restriction/modification | 83 | 253 |
| SW 300 | 1697 | type II restriction endonuclease, putative | Restriction/modification | 83 | 254 |
| SW 300 | 2216 | hypothetical | Unknown function | 83 | 255 |
| SW 301 | | | | 84 | |
| SW 302 | 0383 | membrane-associated zinc metalloprotease, putative | Degradation of proteins, peptides, and glycopeptides | 85 | 256 |

TABLE 2-continued

| Clone Number | Locus | Name of Homologous ORF | Function | SEQ ID NO (DNA) | SEQ ID NO (amino acid) |
|---|---|---|---|---|---|
| SW 302 | 0384 | MutS2 family protein | DNA mismatch binding protein of unknown cellular function | 85 | 257 |
| SW 303 | 0867 | hypothetical | Unknown function | 86 | 347 |
| SW 303 | 0868 | mobilization protein | Plasmid functions | 86 | 258 |
| SW 304 | 0345 | hypothetical, M. avium 23S ribosomal RNA gene | Unknown function | 87 | 259 |
| SW 311 | 2082 | POT family protein | Transport and binding: Amino acids, peptides and amines | 88 | 260 |
| SW 312 | 0668 | TonB-dependent receptor | Transport and binding proteins: Cations | 89 | 261 |
| SW 312 | | partial clone | | 262 | |
| SW 314 | 1775 | grpE protein | Protein folding and stabilization | 90 | 263 |
| SW 316 | 0324 | histidine ammonia-lyase | Energy metabolism: Amino acids and amines | 91 | 264 |
| SW 316 | 0325 | conserved hypothetical | Unknown function | 91 | 265 |
| SW 320 | 2216 | hypothetical | Unknown function | 92 | 266 |
| SW 325 | 2216 | hypothetical | Unknown function | 93 | 267 |
| SW 327 | 0463 | folylpolyglutamate synthase | Biosynthesis of cofactors, prosthetic groups, and carriers | 94 | 268 |
| SW 330 | 0708 | peptidyl-prolyl cis-trans isomerase, FKBP-type, putative | Protein folding and stabilization | 95 | 269 |
| SW 330 | 0709 | peptidyl-prolyl cis-trans isomerase, FkpA, FKBP-type | Protein folding and stabilization | 95 | 270 |
| SW 331 | 1033 | | conserved hypothetical protein | 96 | 348 |
| SW 331 | 1034 | ABC transporter | ATP-binding protein, Transport and binding proteins | 96 | 349 |
| SW 333 | 2216 | hypothetical | Unknown function | 97 | 271 |
| SW 335 | 2086 | hypothetical | Unknown function | 98 | 272 |
| SW 336 | 2086 | hypothetical | Unknown function | 99 | 273 |
| SW 337 | | | | 100 | |
| SW 339 | 0048 | conserved hypothetical | Unknown function | 101 | 274 |
| SW 340 | 0048 | conserved hypothetical | Unknown function | 102 | 275 |
| SW 344 | 2216 | hypothetical | Unknown function | 103 | 276 |
| SW 345 | 2216 | hypothetical | | 104 | 350 |
| SW 347 | | ABC transporter, permease protein, putative | Transport and binding proteins: Unknown substrate | 105 | 277 |
| SW 348 | 0048 | conserved hypothetical | Unknown function | 106 | 278 |
| SW 351 | 2131 | 60 kDa protein | Unknown function | 107 | 279 |
| SW 353 | 2197 | conserved hypothetical | Unknown function | 108 | 280 |
| SW 354 | 2216 | hypothetical | Unknown function | 109 | 281 |
| SW 355 | 1242 | replicative DNA helicase | DNA replication, recombination, and repair | 110 | 282 |
| SW 357 | 0531 | glutamine-dependent NAD+ synthetase | Pyridine nucleotides | 111 | 283 |
| SW 362 | 2066 | hypothetical | Unknown function | 112 | 284 |
| SW 363 | 0181 | immunoreactive 32 kDa antigen PG49 | Unknown function | 113 | 285 |
| SW 365 | 2008 | hypothetical, hypo. tonB linked OMR PG35; PG W50 | Unknown function | 114 | 286 |
| SW 370 | 0868 | mobilization protein | Plasmid functions | 115 | 287 |
| SW 372 | 0277 et al | ISPg2 transposase | Transposon functions | 116 | 288 |
| SW 377 | 1111 | conserved hypothetical, auth. pt. mut., B. uniformis insertion seq. NBU1 | Unknown function | 117 | |
| SW 380 | 0104 | DNA topoisomerase III | DNA replication, recombination, and repair | 118 | 289 |
| SW 383 | 0810 | hypothetical | Unknown function | 119 | 290 |

TABLE 2-continued

| Clone Number | Locus | Name of Homologous ORF | Function | SEQ ID NO (DNA) | SEQ ID NO (amino acid) |
|---|---|---|---|---|---|
| SW 383 | 0811 | Holliday junction DNA helicase RuvA | DNA replication, recombination, and repair | 119 | 291 |
| SW 384 | 2094 | conserved domain protein | Unknown function | 120 | 292 |
| SW 385 | 0095 | DNA mismatch repair protein MutS | Cell division | 121 | 293 |
| SW 386 | 2216 | hypothetical | Unknown function | 122 | 294 |
| SW 397 | 0867 | hypothetical | Unknown function | 123 | 351 |
| SW 397 | 0868 | mobilization protein | Plasmid functions | 123 | 295 |
| SW 412 | 0451 | CBS domain protein | Unknown function | 124 | 352 |
| SW 412 | 0452 | CBS domain protein | Unknown function | 124 | 353 |
| SW 413 | 1391 | hypothetical | Unknown function | 125 | 296 |
| SW 414 | 0048 | conserved hypothetical | Unknown function | 126 | 297 |
| SW 421 | 2086 | hypothetical | Unknown function | 127 | 298 |
| SW 423 | 1988 | hypothetical | Unknown function | 128 | 299 |
| SW 423 | 1989 | hypothetical | Unknown function | 128 | 300 |
| SW 423 | 1990 | hypothetical, Y. pestis put. Virulence factor | Unknown function | 128 | 301 |
| SW 424 | 2131 | 60 kDa protein | Unknown function | 129 | 302 |
| SW 444 | 1977 | hypothetical, pristinomycin biosynthesis | Unknown function | 130 | 303 |
| SW 447 | 2197 | conserved hypothetical | Unknown function | 131 | 304 |
| SW 448 | 2150 | LysM domain protein | Unknown function | 132 | 305 |
| SW 448 | 2151 | hypothetical, P.G. ATCC33277 dnaK operon genes | Unknown function | 132 | 306 |
| SW 455 | 497 | 5'-methylthioadenosine/S-adenosylhomocysteine nucleosidase | | 133 | 354 |
| SW 459 | 1417 | fumarate hydratase class I, anaerobic | Energy metabolism: Anaerobic | 134 | 307 |
| SW 463 | 1331 | NAD(P) transhydrogenase alpha-subunit, authentic frameshift | Energy metabolism: Electron transport | 135 | |
| SW 463 | 1332 | NAD(P) transhydrogenase beta-subunit | Energy metabolism: Electron transport | 135 | 308 |
| SW 468 | 1947 | TPR domain protein | Unknown function | 136 | 309 |
| SW 37, 278 | 1889 | hypothetical | Unknown function | | |
| SW 41, 101 | 0590 et al | ISPg5 transposase ORF1 | Transposon functions | | |
| SW 165, 312 | 0668 | TonB-dependent receptor | Transport and binding proteins: Cations | | |
| SW 287, 316 | 0324 | histidine ammonialyase | Energy metabolism: Amino acids and amines | | |
| SW 287, 316 | 0325 | conserved hypothetical | Unknown function | | |
| SW 351, 424 | 2131 | 60 kDa protein | Unknown function | | |
| SW 353, 447 | 2197 | conserved hypothetical | Unknown function | | |
| SW 303, 370, 397 | 0868 | mobilization protein | Plasmid functions | | |
| SW 335, 336, 421 | 2086 | hypothetical | Unknown function | | |
| SW 56, 115, 151, 223 | 2024 | arginine-specific protease ArgI polyprotein | Degradation of proteins, peptides, and glycopeptides | | |
| SW 78, 107, 129, 267 | 2125 | transcriptional regulator, AraC family | Regulatory DNA interactions | | |
| SW 339, 340, 348, 414 | 0048 | conserved hypothetical | Unknown function | | |
| SW 87, 100, | 0293 | secretion activator protein, putative | Protein and peptide secretion and trafficking | | |

TABLE 2-continued

| Clone Number | Locus | Name of Homologous ORF | Function | SEQ ID NO (DNA) | SEQ ID NO (amino acid) |
|---|---|---|---|---|---|
| 214, 263, 286 | | | | | |
| SW 34, 64, 115, 151 | 1844 | lysine-specific cysteine proteinase, authentic frameshift | Degradation of proteins, peptides, and glycopeptides | | |
| SW 36, 43 | 2071 | conserved domain protein | Unknown function | | |
| SW 36, 43 | 2072 | UvrD/REP helicase domain protein | Unknown function (Repair-putative) | | |
| SW 54, 320, 325, 333, 344, 300, 354, 386 | 2216 | hypothetical | Unknown function | | |
| SW 80, 88, 302 | 0383 | membrane-associated zinc metalloprotease, putative | Degradation of proteins, peptides, and glycopeptides | | |
| SW 80, 88, 302 | 0384 | MutS2 family protein | DNA mismatch binding protein of unknown cellular function | | |
| YHS 1/p | 1082 | Phosphotransacetylase | Energy metabolism: Fermentation | 137 | 310 |
| YHS 1/t | 1081 | Acetate kinase | Energy metabolism: Fermentation | 138 | 311 |
| YHS 10/p | 0333 | membrane protein, putative | Cell envelope | 139 | 312 |
| YHS 10/t | | | | 140 | |
| YHS 15/p | 1774 | transcription-repair coupling factor | DNA replication, recombination, and repair | 141 | 313 |
| YHS 15/t | | | | 142 | |
| YHS 18/p | 2204 | hypothetical protein | Hypothetical proteins | 143 | 314 |
| YHS 18/t | | | | 144 | |
| YHS 23/p | 1017 | pyruvate phosphate dikinase | Energy metabolism | 145 | 315 |
| YHS 23/p | 1018 | hypothetical protein | Hypothetical proteins | 145 | 316 |
| YHS 23/t | | | | 146 | |
| YHS 28/p | 0339 | hypothetical protein | Hypothetical proteins | 147 | 317 |
| YHS 28/t | | | | 148 | |
| YHS 32/p | 1896 | S-adenosylmethionine synthase | Central intermediary metabolism | 149 | 318 |
| YHS 32/t | | | | 150 | |
| YHS 34/p | 0196 | peptidase, M16 family | Degradation of proteins, peptides, and glycopeptides | 151 | 319 |
| YHS 34/t | | | | 152 | |
| YHS 40/p | 0365 | 3'–5' exonuclease domain protein | Unknown function | 153 | 320 |
| YHS 40/p | 0064 | heavy metal efflux pump, CzcA family | Transport and binding proteins | 153 | 321 |
| YHS 40/p | 0364 | conserved hypothetical protein | Hypothetical proteins | 153 | 322 |
| YHS 40/t | 2076 | hypothetical protein | Hypothetical proteins | 154 | 323 |
| YHS 46/p | 1697 | type II restriction endonuclease, putative | DNA metabolism: Restriction/modification | 155 | 324 |
| YHS 46/t | 1214 | hypothetical protein | Hypothetical proteins | 156 | 325 |
| YHS 48/p | | None | Unknown function | 157 | |
| YHS 48/t | 0680 | conserved hypothetical protein | Hypothetical proteins | 158 | 326 |

TABLE 2-continued

| Clone Number | Locus | Name of Homologous ORF | Function | SEQ ID NO (DNA) | SEQ ID NO (amino acid) |
|---|---|---|---|---|---|
| YHS 52/p | 0701 | cobinamide kinase/cobinamide phosphate guanylyltransferase | Biosynthesis of cofactors, prosthetic groups, and carriers | 159 | 327 |
| YHS 52/p | 0700 | hypothetical protein | Hypothetical proteins | 159 | 328 |
| YHS 52/t | 1880 | glycosyl transferase, group 2 family protein | Biosynthesis and degradation of surface polysaccharides and lipopolysaccharides | 160 | 329 |
| YHS 52/t | 1881 | hypothetical protein | Hypothetical proteins | 160 | 330 |
| YHS 53/p | 0217 | hypothetical protein | Hypothetical proteins | 161 | 331 |
| YHS 53/t | 0386 | site-specific recombinase, phage integrase family/ ribosomal subunit interface protein | DNA replication, recombination, and repair | 162 | 332 |
| YHS 55/p | 1436 | ATPase, putative | Central intermediary metabolism | 163 | 333 |
| YHS 55/t | 1435 | integrase | Central intermediary metabolism | 164 | 334 |
| YHS 56/p | 1656 | methylmalonyl-CoA mutase, small subunit | Energy metabolism: Fermentation | 165 | 335 |
| YHS 56/p | 1413 | hypothetical protein | Hypothetical proteins | 165 | 336 |
| YHS 56/p | 1168 | hypothetical protein | Hypothetical proteins | 165 | 337 |
| YHS 56/p | 1925 | ribosomal protein S14 | Ribosomal proteins: synthesis and modification | 165 | 338 |
| YHS 56/p | 2040 | hypothetical protein | Hypothetical proteins | 165 | 339 |
| YHS 56/t | | | | 166 | |

Sequences with 85% homology or higher were chosen. In all cases, homologous sequences are liste according to degree of homology in descending order for each clone. For sequencing, the T7 promoter and terminator primers were used. Sequences arising from both primers were blasted against the TIGR *P. gingivalis* database. When a particular homology showed up from sequence derived from both primers, only the one from the promoter primer was reported here.

SEQUENCE LISTING (354 sequences)

SEQ ID NO: 1 - DNA, 796 bp, Porphyromonas gingivalis
  misc_feature: P.g. IVIAT sequences from hydro-sheared P. gingivalis W83 genomic bank
caaacaatatggcgaacaatgggaataacaagaaacccggaaaagcgatgcgttgcaaccgcgatatggctcttaggatatctatactgatgagcttgcttgttttttcctccttgtgctaagctctgccggatgtaaagatgatgtccagatctgacatatttaaggggcctgtggactacgtgaatccttatatgggcaatatcagtcatctgctcattcccacttttcccactgtgcatttgcccaatagtatgttgcgcatgtgtccggtacgaaccgactatacttctcagttgatggacggactgcccctgttgctgacctctcatcgcggagcaaatgcttttcgtctcagtccgctgaaccacctgccggattccatccccgcagttgcgcgctatacctatgacaatgaagcggtgcgtccttaccgctattccgtcttgctcgatgaggaggatgtagaggtggattttgcgccttcttttcgtagtgccatttaccgcttgggtttcaatgccgatagcagccggcattacctcgttgttcactctgagaaaggggaattgactgccgaaggtaatgtcatatccggctatcgctatcttcaggacagtacgcgagtatttgtctatatggagacggagcagcagcctgtgacgtacgctcgccgttcggaaaaaggcgagtacatctggaatacgggcaaggtaacgggcaaaactctcgtgctgaactacgatctggccggaacggatctctttcttcgctatggtattcctatatcagtgtg

SEQ ID NO: 2 - DNA, 599 bp, Porphyromonas gingivalis
aagaagtcagtacggcattcggaataaccgtatatcccggcgaaagaaacataaaccaatagagcgggtcggctgttctttgcaaagttatggttcaggatttcagcgagtatcgaacaaatactcctgcatttttcttaagtagaaaaaataaaactgcgtatgcccctgtatttctgatattggccaccctcttctttgtcgatcgggatattacatcccagaaagaactcagctggaatgagtttcagaatatcgccaaaaagcaagcctttacggacatcgtagtcaatcggaaagagaacactctcaaggcgagggtcgatccggccaaggtcgattcggtattcaagaaaggcgacatcccgtcctttcaggacagaggaaatatctcagactactatatcaacacgcaaatgccgtcggtagacaaattctccgacttctacgaacaaaaccaaattacgggtaaggtgaagtatgaagacagcaagttcagcttcacctctatcctcattacatggggcccactcatccttttgctcgttttctggttttggatgatgcgccgaatgagcggcggtggaggaggaagtggc

SEQ ID NO: 3 - DNA, 626 bp, Porphyromonas gingivalis
actcacatcaacgggaaataatgaagggggattgagcagatcggagtatgagtattcggtgccattcgaataggctaaagagatgcttactctatgccttcccggctatattatgaagcagcggtattgcgtccctcacaaaggccatgtatgggaagtggatgtattcgaaggccggcacaaagggcttgtaattgccgaagtagagcttgccactgaggacgaaagcatagagcttcccgattggatcggaaatgaagtgacgggagacaagcggtactacaactcattcattgccggcattcagaagtgaggaatgccatccacaaggacactaagaagaacaatcaacatacaaaataaaacgaagtaataatgaaaaaaagactattgctccccctctttgcagttctctggctgtgccagatagctcatgcggacgagggtatgtggctgatgcaacagctcggacggaagtatgcgcagatgaaagagcgcggacttaagatgaaggaatacgacctttataatcccaacggcacatcgctgaaagatgccgtagtgctattcgacggaggatgtacgggcgaggtcgtctccgatcgcggactggtactgaacaatca

SEQ ID NO: 4 - DNA, 912 bp, Porphyromonas gingivalis
ctgctctcatcactacttccttctggtctgctgccatgcggcttcctggtatgagctgaaaccgctgctgctaaattcgaacgccacgcacatggacatgcccacgatctgggtacctgacgacgacgacaaggccatggtgatgggtcttggcaagtccccggtatcgacatcgtccgccatgaaaccaccggcgaatactgccaaaggtgcgttcgatggtgctccgtatctccacaaggcttgcatcgacaagcaccctttccctgaccgaaatgtgatggcgggaaagttgtttgttaaactgcgccaatagtttgtccatgagccccaactctgtcagtgccgaacgacaatccgacttgattggtgctgtggtcgggagatacctcttccatagacccaagaatcgggaaaaggtgattgaatcattgatgcgctcctccaaagcacaatcactgaggttgtaccatgtcttcggaagcaacatcttgaatcacagaatcacgtcataagccggggcgccgatggcatacagtcgcttcgtgtattacttgttgatcagcggtctgatcggacgccaatccgataagctgtcacctgattcgaggaaagccgaaggggctttgcaaaacgcttggacggagtcgtatgcaaatgttcattgtcaagggatcctgggtgggatgcctgggagcatctatgcgcttcatatcaattacagaagtccgatatactgatacacaaaaaaccagcgggcaggcattgcaggtccctaagtacgggcaaaaaaagccacttagcacagacgaactgaaccttagtgagcgcacatggttgcgacaatagctgactattattagacgctacaacgcccacgccacctcgcagcacccctgacaccacgcatac

SEQ ID NO: 5 - DNA, 794 bp, Porphyromonas gingivalis
ctgggtaccgacgacgacgacaaggccatgggataatacagagatattatcgaacatttggcagccgaatttgaggtcacggacgaagaacgcaaggaactcttggcaagtggctccaaagctgtttttgacaatcgcgttggctgggcaagaacatacctaaagaaggctggccttcttgattcgcctaaacgagcgattcttataatttctgaccttggcagagagatactttcgaagaatcccccaaaaatagacacaaaatacctaagacggtttccggcgtttatagaatttcagaacggttatcgaaatgacggcgaaacagaagaagaatccataacagaaaaaatacacgaacaaacacctgaagaggtccttgacaaagcatatcaaagaaattggcttccgaattacttaataaagtcattgacctttcacctgctttttttgagaggcttgttgtcgaattattagtcaaaatgggatatggaggttctatcaaggatgccggtaaagcattaggcaaaagtggagacgagggaattgacggaacaataaaagaagataaactgggacttgatattatttatatccaagccaagcgctggaggcctgggaatgtggtaggaagacctgagcttcaaaagtttgttggagcactcgctggacaaggtgccaaaaaagggatctttataacaacttcaaattttacaaaggaagcattaacttatacacccaggaatgagactaaaattgtattgattgatggggaacaactaactcaattaatg

SEQ ID NO: 6 - DNA, 722 bp, Porphyromonas gingivalis
gcaaaaggttatcacatcatgcacaatgtccgtattggcagtcatcagcgtagtgtcggatttaatgcgagcagtggtctcattaaaattccccgtagagagcaaagcgatgccttgcggacgtcaccggccggtgtatgatagaggatgagagccgttttggcatggactttcagcccgggcatactgtaaacgatccgaatccccgaacggcgcatacgctctgacaaacgcaagttgttttcctcatcgaatcgggctttcaactccacgaagacagataccttctttccactctgtgcagccgcttccaatgcactgataatggacgaattttcagctacgcgatactgtgtaaggcgtatttccgacacatccggtgagatggccgcttccatcagcaggcgcacgacatagtcatacgtatagtaaggcacatgaatcaggtagtccttcctacgaatgccttccatcagagagggggcctgctccaaatgcttcgagaggagaggctccggcgtgagtgtctccagtctgggggcaaacggattgggcagcatagccagatcttgcagattgacgtagtttccactccgaatcgcctcctccggatcgatgtcgcacgaactgatctgtggatccgaattcgagctccgtcgacaagcttgaggccgcactcgagcaacaacaacaccaacactgagatccggctgctaacaaag

SEQ ID NO: 7 - DNA, 707 bp, Porphyromonas gingivalis
  misc_feature (492)..(707): n = A, C, G or T
agcttgggatggagaagatcaccacataatgatcaagatttcgactatcggcataccgctcatattcgtttgggagtattgctgtcgggttgttacggattcgatccgatcaaggataaacaaaacaagctgaaggaagaactcaataacggaggcagcgagacttcgccgactcctccggagggacagtcggtattcgatgtccgtttttctttcgagaagtggtcggacacaactcctgccctgccgttgggagaggggggattttcctcctctttttggatctgtggatccgaattcgagctccgtcgacaagcttgcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 8 - DNA, 160 bp, Porphyromonas gingivalis
tagggatgacactgtttcatattggctctttgctatggcgatccgaccgtacctccgcgtgaggctttcaatcgcaaaattattgaagaggtagtcagcttcgagaaattatgaaactgttggtcagtgtttagctggcctgttcctggggaatgatcac

SEQ ID NO: 9 - DNA, 801 bp, Porphyromonas gingivalis
ggtcgacgagagcaaggcttgggatttcacttatgaagacctagccccttggttgactgggaaatttcactgaatgaagaaaagaatatccaggatatctatgtaaaaaagctacgtgttcttatagaggacggatttatcaggcttggtattcagaagatattcctattcctatggggccatatgtctttggaggcttacccggcttgatcatggagattcgagactctaataacgagtatgtttttgttgcaatggcagtcttgttgataaaaaattatgatcccatatatcgagtgaatacgccttatgaattcctttatgaaagagataaatcttggcatgaaatcaagaaaagttatcaaaatctatattttgagattgatgggaaaattctccgatcagtgacaccatacaatccaattgaaaaggattagtttcttcgcatacagcagagccttaaaaagccaaattccgcagagagttagttttcgttagttcgaatttgattcttcgaccaaggtccaatagagccttatagtttcggatagaaataggacataatcctaatttgatagcgtttttatgagacctttgaaaaataaggaaatggagggaagaggaattcttcacataaaacggggggagggacacggggtggcagtaaggagtgaaagtagttgtaatcccccttgaggagctacttgcacgagctcctcacgggggtaatgcttatcctaggatgaggaataatatcccggagtctgcataattaacgcgagcttcagacagttgagatgg

SEQ ID NO: 10 - DNA, 831 bp, Porphyromonas gingivalis
cactgtttgatcgaaaaagtgcgcttccgcacagctgtttcaaagcaggaccgcacgattctgtgtgctgaacctgtgcgggtgccttatatctttggagtgagtataggagtgagttattcctacttattcgtcatagtggatatatgcttgtttgtccaaatatcgagatggctgtggtatgttatgggcgcgaaaggatctggcctggacaagcatcgggggtataaatgtgttcggtgcacatgttctgttatagtctattatcccatgtagttctattcaagcaatcggctctcttggcagagacatccaacttcctacagagagcttcatcggtgctgcacaaattgtaagaaaatattccagtctcggtgcagcatattgaacaaaatctgggtctgttcagccatcacactcctgtgcccctgagtggactgtcattattgcatgcagttgcttattatggttttgaagaaagtacaaaaactgattacgatcaaatacatagtgtgtaccaaaaatactttcgacagaccctcctctaatgtaccttgcatatctttgtacaaaaatcaggccgagatgccttctttctaatctaacttggaatgtattaacaaaaaaaacaaaccacactaaacaaacagaatggagatacaatacgcacacaaagacacagcacaacatgaatacgcaaaggacgaaacacaaaacaaacagacacgagacaccaaaccagaaaagaaaacaacgaagacaaacaacaggagaaacaaacagaacacgaacaaaaaaaaaaaccgagcaaaagaaatagaaaaacaacaa

SEQ ID NO: 11 - DNA, 777 bp, Porphyromonas gingivalis
agcttgggatggatttttttgtttttttaaccctgcgtggttctctgaatcacgaccataaatgttttaaagtatgaggaaattattattgctgatcgcggcgtccctttgggagttggtctttacgcccaaagcgccaagattaagcttgatgctccgactactcgaacgacatgtacgaacaatagcttcaagcagttcgatgcaagcttttcgttcaatgaagtcgagctgacaaaggtggagaccaaaggtggtactttcgcctcagtgtcaattccgggtgcattcccgaccggtgaggttggttctcccgaagtgccagcagttaggaagttgattgctgtgcctgtcggagccacacctgttgttcgcgtgaaaagttttaccgagcaagtttactctctgaaccaatacggttccgaaaaactcatgccacatcaaccctctatgagcaagagtgatgatcccgaaaaggttcccttcgtttacaatgctgctgcttatgcacgcaaaggttttgtcggacaagaactgacccaagtagaaatgttggggacaatgcgtggtgttcgcattgcagctcttaccattaatcctgttcagtatgatgtggttgcaaaccaattgaaggttagaaacaacatcgaaattgaagtaagctttcaaggagctgatgaagtagctacacaacgtttgtatgatgcttcttttagcccttatttcgaaacagcttataaacagctcttcaatagagatgttatacagatcatggcg

SEQ ID NO: 12 - DNA, 747 bp, Porphyromonas gingivalis
  misc_feature (34)..(34): N = A, G, C or T
aagaccaccagcttttggatgatggacagcgaantggcaagccagtttgtgcaagatgatactcgtcagtcaggtgccctgtttatcctgcattttcttcatttggccgcaattcctggtattttcacttcctcggatggctgagctgggctattcggactccgcgcatccctgccgagctattcaataagcgagggcatattttcgatgtctatatcggcgatccgatcccgccagagactatcgctcgcttcgagaagaatccgcgcgagctggctctcttcctctatgaccggacttatcgtcttgcccccggacacaagaaaaacaaatgaaacgctccaagcaactccgcatttatacagcttcggcgggttccggcaagactcatacactcaccggcgaatatcttcgtttagccctgcgtacgcgcggggctttccgttatatacaggctgtcacgttcacgaacaaagccactgccgaaatgaaggagcgtattctcgaggagctgtacagtctggctgtgggcggatcgtcccctttcgccgaggagctgatgcaggagttggctctgactaccgagcagctacaagtcagagcacaggaagtcctgaccgaaatactaaacgactattcttctttgcgagtcaagagcattgactccttcttacaggaagtaatgcgtgacttctctcatgaattgggactggcgggttggtacggatcgaagatggagcagaatgc

SEQ ID NO: 13 - DNA, 639 bp, Porphyromonas gingivalis
caggcttgggatgcgaactgaacagcacgcacggcttcccatcatcgtatgcggcacctgcgccgactactatgaagtgaaagacatactacgcatcggtaccatctccaatatgtaccggatcatgcagcttcaagtagccacacgccacattatctatccttgagaaactgctcatcgaacaattggtatatctttgttcgcggacattttccgtccatgcgaacccaataccctatgaatcgggaggagaatgtcacatgaagaaaagaacaagaacactcacaaaaaaacgaataacagcttatgttacgaattggaaaaacgatcttcggactcatagcactgaccattctcttgggatcatgctggtccaagaagaacgacttgggtcatgacatcccgtctcaattggtttgtcgcttcacggaaggagtacttaccgaaccggcagataacagtataaacgtaagtccaacagcattcttctccaaagataccgtaagtattcaccacatggtctccaatgcttttggctcttttgcagccctacccggtagccagaaaccaaagcttaagaagggaatatggtataaaatggagatttatcttttcgacaaggagaacaaacgactaaac

SEQ ID NO: 14 - DNA, 909 bp, Porphyromonas gingivalis
ctactggccgacgacgacccaggcgtatggatcgttgacgtgtactgcaagatacagttggcgggatgcaaccagtatccattatgggcaaacattgaaagaatttgaacgccttagcagccttgaggattacctctcggggtcagatagcaaagtagccattgagcagaaatatggtctaagtcatggtctcattcgctcttggcttagtaaatttggactcgaagataaagttcatccagtcccaatgaaagtgtcccaatccccccagagtgagctacccctgaacgaaaaagaagaattagagcagctacgtaaagaaaatcgtgtcctcaagagtcgtctcaagcgagaagaactagggcatcaagcctacaagctacttgtagagttggcagaagaaacctacggcattcagatacgaaaaaactccgaagccaagtagttcaccgtttatcagagccggagcctaggtatcctattgctcgactctgcgaactgcttggctttagccgtcaggccttttataaacgtcatctcaacgatttagcacaacatgaggaggatgtcctatgcagtagtatcatccaatattgttggcacttaagacaagcagagcacctacctcaagccggcttccgagagctcatggtgctttgtcagcaatacttcggccccaagttcacgcttgggcgcgatcgcttttgcgccctactcagacgccatggtatgatgctgcgcaaacggtctgtgcgccctcggacaaccactctcggcataggtctacagtatgagacggtccatacgagccagttgggctcaagacgggaaccttgtaaaatcctaagggttcaaagggttgctattccaagaagagcaagacagacaggtgtacacccaaggacggca

SEQ ID NO: 15 - DNA, 764 bp, Porphyromonas gingivalis
tggcttgggatgatggacagcgaatggcaagccagttgtgccaagatgatactcgtcagtcaggtgcccgtttatccgattttcttcagtggccgcaattcctggtattttcacttcctcggatggctgagctgggctattcggactccgcgcatccctgccgagctattcaataagcgagggcatattttcgatgtctatatcggcgatccgatcccgccagagactatcgctcgcttcgagaagaatccgcgcgagctggctctcttcctctatgaccggacttatcgtcttgcccccggacacaagaaaaacaaatgaaacgctccaagcaactccgcatttatacagcttcggcgggttccggcaagactcatacacttaccggcgaatatcttcgtttagccctgcgtacgcgcggggctttccgttatatacaggctgtcacgttcacgaacaaagccactgccgaaatgaaggagcgtattctcgaggagctgtacagtctggctgtgggcggatcgtcccctttcgccgaggagctgatgcaggagttggctctgactaccgagcagctacaagtcagagcacaggaagtcctgaccgaaatactaaacgactattcttctttgcgagtcaagaccattgactccttctttcaggaagtaatgcgtgccttctctcatgaattgggactgccgggtggttttcggatcgagatggagcagaagggcgtgctcgaacaggctgtccgtccgtctgct

SEQ ID NO: 16 - DNA, 858 bp, Porphyromonas gingivalis
agcacagctagggatagaaggtgcagagtgatgttcgttcgcaatgatactcgccaacctagacgctactacaacgggaaaatagccgtatgtccactccctttctccttcctcggtggtcgttcggactgacggcggagagcttatagaggtagagccacacgagtggaccaacgtccgctactccgtgaaccccgagaccaatgcccccgaacaggaagtaatcggcagcttccgcctttttccgcttcgagccgcttgggctatcaccgtgcacaagagccaaggactgactttcgaacacgccgccatagatctggaaggtgtcttcgttcccggtcaggcctacgtagccctgtcacgtatgacgggccctgaaggaatgatactgctctcccctcccgatctgcgtgggttggaaactccccaagaactggtcgaatatgcacagacgaagcccgacgaaaaagaactccggacttctttgcaggaaaacagtcttatctattggaagcagcaatccgacgaggctttcgactggcagagcttgttgaatatatggcacaaacacagtctcagctatcgggaggagagcgagctgagcagcaaaagccattacagcgatagagcagccgaacaatcggccaagatagatgcgatcccggaagtagccggacgtattcgccgcgcacttgccggcctttgggggcagctccggttggatcaggtgccgtcaagagcgatcgaccaagcgggactattcctacacaatttctgcatagcaggggactactccagatcacaagtcgcagttgaaaccaaacgtcggaacgatgggagtacgagacataaacccgg

SEQ ID NO: 17 - DNA, 504 bp, Porphyromonas gingivalis
ctgggtaccgacgacgacgacaaggccatgggatatagtcgctattctatttttaagttcttagacaaaactactcaaaataataacgtcatgtctcaagaaaatcgtacttgtggttcgtaaataatttcataggccaatggaggattttttccctcctcacatcgtttcgccgacttggtggttttttctctactttagcgggcggaaaaattattcgcaagcatatttttcttctccccaaactctttgcttttttcgcaaatgccaaggatcgatcgaaaaatctcattctaaaatcaccaataattatcaccaatacaagtatgaaaagaagcagacttttaggccgcatcgtagtactatctctatgcgttgccacaattccggcttcggctgtcagccaaccgcagatgacgcccttgcagtcgacacacacctccgatcgttcgttcggcaggggagctcagcagatagctgacgaatggagtgccgccatgcccc

SEQ ID NO: 18 - DNA, 874 bp, Porphyromonas gingivalis
acccaaggtttgggatatagactgtataggtctagcttgttggtgaatcgtcttcgacttccatatcagttccatctcccattccggcgcgtcgcatcgtgaaggtgtacttcttgcctgcttcgaatgtgaaatcgtcataacgtgcaggctggttgcctccatctcctgcgatccacatctttccggatgcaggttccgggttcgtaatgcaatagtcgtaaacaccaccggggattacaacttcaccctgtcctgtaacgataatattctgtgtagtaacaacaggatcggcattggccgggatcaaatactcgaagttcgcactgtaaagatcggaagaagcatctgtggatccgaattcgagctccgtcgacaagcttgcggccgcactcgagcaccaccaccaccaccactgagatccggctgctaacaaagcccgaaaggaagctgagttggctgctgacaccgctgagcaataactagcataaccccttggggcctctaaacgggtcttgaggggtaatttgctgaaaggaggaactatatccggatcggcgaatgggacgcgccctgtagcggcgcattaagcgcggcgggtgtggtggttacgcgcagtgtgaccgctacacttgacagagccctagagagcgaacattacgataaataccttccttactcgccagtcgccggatacccgtcaagcctaatcggggctcattaggatcgaatacgactaagcacagaaccaaacatgaatcgtgtgtaccgtaggacaagcgacaagaaagccagaatgaacagactaaacgacgacaggaaaacaagaaggaactaaaaagacaaaaagaaaaagaacaagaaacaaacagca

SEQ ID NO: 19 - DNA, 892 bp, Porphyromonas gingivalis
gtcgacgacgacacaggtttgggatccacgaattcatataccagagatttaattctagagaaaagaaactgaaaaaattcaaatgcgatcgccttgagccttaagaatgaacctgtacacccttgaaaaaattacgtttttgcggtgtcggggtgtattgtataaaagactatagtataatagagaccattgcacaaatccagctcaccaataccgaacaagtttccttgtgttttttgagcatttagatgtgtttctcagcttggggattagcaccctttcccgccaatcagggaaaggcaaatggcaattgaaataagtctgttcaattttttcatactaacaaaaagattatactgttttaggggtcggactcctacatgagaaaacatgcggaaatgtcttctaaataggacaaaatccacggaaatctataataaggacacgcctcagcgatgtaatcaaatttcttcatgacgataaaaatttggaactgagccagggcaatcgcattagagatcggatgatagtatttgggaaggttttctgagggcgtatatcttttgcagcgcattgaatgagctttcgggtctgctcttcaatcgtccgagaaagaagagagctatcttatggattatatcgacatttttggctgcattgtcctttcgtctgagcgatcgatcttctccgagaatgaatcatgacaatggtacagatcgtctctaatggccaatggtatcgatgagctacagactctcggcattgacgatattccatatcttcaaacagggacccgaccaaagtaaggccgtaaaaatttaacagccctgatgatggcccgtagggcaacataccgataactgcgccacaagcggagaccacaaagctctta

SEQ ID NO: 20 - DNA, 890 bp, Porphyromonas gingivalis
  misc_feature (13)..(13): N = A, G, C or T
gacgacgcacagntttgggatcgatgccaatggcaacactgtccagttgagaaggaacccaatgccggcaatcccgtgcgcaaagggttgaatcctttgttcggattcgacgtatgggagcacgcatattatctgacttaccagaatcgtcgtgccgaccacctcaaagatctttggagtatcgttgactgggatattgtagaatctcggtattaagaactccatgggtgcactttgcaccaatacataaggaagcctctgccaagaaccgctcggttgtctcggcaagagatctgtggatccgaattcgagctccgtcgacaagcttgcggccgcactcgagcaccaccaccaccaccactgagatccggctgctaacaaagcccgaaaggaagctgagttggctgctgccaccgctgagcaataactagcataaccccttggggcctataaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttccccttcctttctcgccacgttcgccggctttccccgtcagctctaaatcgggggctccctttagggttccgatatagtgctttaagggacctcgagcccaaaaaacttgaataagggtgatggtcacgtagtggggcatcgccctgtataacgggttacggcctttgacgttggagtcaccgtctttattagtggatttgtacaaatggagaaaatcaagctattgggacaccttgagacaaagagaatgcggataggcaaggtaaaaaatgtta

SEQ ID NO: 21 - DNA, 747 bp, Porphyromonas gingivalis
  misc_feature (583)..(747): N = A, G, C  or T
atgctagggatctgtcgaaatggagtacgcacgccgtcgcgaggaagagctgcgtcgcgagttggccgagcaacgcgaggttatgcgtcggctggccaaagaatatgtgctgatgggcaatgactgtatcacagaggctcatgatgcccatgctgctattcgctgctacgacaaggcccttacgctctaccccgactatgtggaagccttagtcaggaaaggcaagacattagccgggctgaatgagataaccacttccctctccaccttgaaccaagccatagccattgctccgatggactttactgccagattcacattgggacaagtcttggagaaattcgcttactatgaagaagccctcgatgcgtacatctgtggatccgaattcgagctccgtcgacaagcttgcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 22 - DNA, 742 bp, Porphyromonas gingivalis
  misc_feature (260)..(742): N = A, G, C or T
agacacagcttgggatagacgcactcctttcaaagcgttatcgcaaagcaatctgtggatccgaattcgagctccgtcgacaagcttgcggtcgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23 - DNA, 802 bp, Porphyromonas gingivalis
caggagagcacatgcttgggatggatttttttgttttctttaaccctgtgcgtggttctctgaatcacgaccataaattgttttaaagtatgaggaaattattattgctgatcgcggcgtcccttttgggagttggtctttacgcccaaagcgccaagattaagcttgatgctccgactactcgaacgacatgtacgaacaatagcttcaagcagttcgatgcaagcttttcgttcaatgaagtcgagctgacaaaggtggagaccaaaggtggtactttcgcctcagtgtcaattccgggtgcattcccgaccggtgaggttggttctcccgaagctgccagcagttaggaagttgattgctgtgcctgtcggagccacacctgttgttcgcgctgaaaagtcataccgagcaacgctcactctctgaaccaatacggttccgaacaactcatgccacatcaaccctctatgagcaagagtgactgatcccgaaaaggttcccttcgtctacaactgctgctgcttactgcaccgcaaaggcttcgctcggacaagaactgacccaagtacacacgtaggggacaccgcgcctggcgtcgcactcgcccgcctcctacccttacccggtcccgcatgatgtgcctgcccccccctgaccgtcggagctacatcggcccgcctttcccttcccgccccgcttacctccctcccgcgtttgcctatgctctctcccccttctccccgcccctctcccgccttcccccgcccgctcccgccctgccccgtcctccccccccccc

SEQ ID NO: 24 - DNA, 658 bp, Porphyromonas gingivalis
  misc_feature (287)..(658): N = A, G, C or T
tggctgtataaatctaccgtattgcgttgccacttgcggatcggcacagtgaattgtgcaggatggataaggatgaaatctgtggatccgaattcgagctccgtcgacaagcttgcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25 - DNA, 796 bp, Porphyromonas gingivalis
accaatgcttgggatgtgcactttcttgcgcaggtctttatcgtttacttcatggctgtattcacgcttttgaagttttcctacagcttcggatagttcgagctgcgccttgcactgtaccttgatggcttcgtgtgccacgcgtatgccttcgagcatttcggattcctgtacctcgtccatttcaccttcgaccatcatgatgttgtccattgtggctccgaccatcaagtcgatgtctgcgcgttcgagctgctcgaaagtaggattgacgatatagcggccgtccacacgtgctacgcgcacttcgctgatagggccgttgaacggtatatcggaaacggcaagagccgccgaagcagccagaccggccaaggcgtcgggcatatcctcgccatcggctgaaaagaggatcacattgacgaatacctctgcatgataattgtccgggaatagcggacgaagggcacgatccacaaggcggcaggtcaggatctcgtaatccgaagctttgccttcgcggcgagtgaatcctccggggaagcgtccgatggcggagtatctctctttgtattccagctgaagaggcatgaagtcgcagccggggttagcgtctttggctgcacaaactgtagcgagcaataccgtataggcccatggtgactgtcccggcgccacgggctgttggcaatctgggatccgaatcagctcggcgagagctgcggcgactcgacccaacaccacacatgacaccggtggaaaaagccgaaggaatgattggtgtgaccagtcaaac

SEQ ID NO: 26 - DNA, 856 bp, Porphyromonas gingivalis
ctgggtaccgacgacgacgacaaggccatgggatatgactattccgctaaaggtattctcgatcaatgagcttgcaggatacttgggggggtaaaatgaatacgcttggagaccgggtcttgctgtgcaatgacaagcgatccctcccggctgcagctgtggctacgccgttcctgttcgaatccatgctcttttctgtttgcacgcgtggctatgcacgactattgatcgattcgagggagatcgaggtgaaggagggcgagctattggtagtcatgcctcgcaagacgatagaagtgatagaatcctcttgctttcgtgcctttcatttatgtctggacaaggagattcttgctttatcggcgatcaggatcagcggttttatctctatcatcaataagctacacagcaacgaaccgttccgtccggaacgcatggagaaagattttctgacggcaacgttggatctcatccgcaacgccctgcaaaacggggggcgtcatcaggaagaaattgtcatctatctgatcagctctctctttctctttcttgacgatatgattgccgacgaggtcgagaaggactgcaagcacaccaggtcggagactatttgccgcgactttctgctcctcgtctccgagcatcacaaagagcagcatacggtcaagttctatgcagacaggctgtgcctcagctccaaacatttggcactgacgataaagaccgtcatgggacagtctgcctccaaagtcatcaacagcttcatcatccagcaggccaagtccttgctgcgctatacggataagacggtccaggagatcggctatgagctgaacttctccacccagtcgttttt

SEQ ID NO: 27 - DNA, 858 bp, Porphyromonas gingivalis
ctgggtaccgacgacgacgacaaggccatgggatacatggaagaaacggatgagagcctcgattgtcctcagagcagtagccacatcctgcaactctcgctcttccagataggtaccggcaggtcggatacggtttagtgcttctcgcacatcggccagacggagatcgggaaacaagtcttcttctctcaggataatctgcatttcttccgtctcggcaagcaagcggctgacttcgttatgccttgcaagagcatgcatctgtattacccgatcgctgcccatcggactatggcaatggccgatgagaaggcgacgaatctcatcgaaacccactttctcctcgaagttgtgggggtaagtctccatccgaatcatagcggtctgtcagcgaaaagccctgagcaagtcattgccattggcatagagaacgagaagaatcagaatagccatcccgatcaattgcgcacggataaggacttcctgaccgactttcctgcgggtaatgatttcaataagaagaaagagaatatgtcctccatccaatgccggtatgggcagaatgttcatgacggccagcatgatggagagaagtgccgtcatagcccagaattgaggccagttccaagaggccgggaaaaggctgcccaatgtcccgaagccacctatctgtcctgccccttctttggtgaagacgtacttcatgtcgcttacgtagctgcgcatggtgcccataccttgtgctattccggccggtatggcttcgaatagcgaatatcggatatgatcgatggtatagatggcatccaacggtcggaggctcactccgataagtccgccggtatctaccggcagcgt

SEQ ID NO: 28 - DNA, 501 bp, Porphyromonas gingivalis
atctgggtaccgacgacgacgacaaggccatgggatttgatttatgttgaactcaaagaagttgaagaaagatggcaaatgttaagttattactcccatatatattgaaatgggaaggtggttttgtccatgatcctgccgatgcaggaggggcaacaaacaaaggtgtaacaatagcgacttggaaaagagtcggctatgacaaagacggcgatggagacatcgatgttgaggatctcaagttgctaaccgatgatgacgtcctgaatcgagtcttgaaaccattttattgggatcgttggaaagctgacttaatcgagtctcaaaaggtggctaatatccttgtcgattgggtttggggttcaggcaagtatggtattgttattcctcaaaggatactaggtgtgcaggctgatggaatagtgggcaataagaccttacaggctgtcaatagtgcagatcccgatgagctgtttgagtccatcttcgatgcacgtcgcg

SEQ ID NO: 29 - DNA, 911 bp, Porphyromonas gingivalis
  misc_feature (41)..(41): N = A, G, C or T
tcctatggttatgatacatggaagaaacggctgagaggttnatgtcctcagagcagtagccacatcctgcaactctcgctctgccagatttgtaccggcaggtcggatacggtttagtgcttctcgcacatcggccagacggagatcgggaaacaagtcttcttctctcaggataatctgcatttcttccgtctcggcaagcaagcggctgacttcgttatgccttgcaagagcatgcatctgtattacccgatcgctgcccatcggactatggcaatggccgatgagaaggcgacgaatctcatcgaaacccactttctcctcgaagttgtgggggtaagtctccatccgaatcatagcggtctgtcagcgaaaagccctgagcaagtcattgccattggcatagagaacgagaagaatcagaatagccatcccgatcaattgcgcacggataaggacttcctgaccgactttcctgcgggtaatgatttcaataagaagaaagagaatatgtcctccatccaatgccggtatgggcagaatgttcatgacggacagcatgatggagagaagtgccgtcatagcccagaattgacggcagttccaagaggccgggaaaaggctgccaatgtcccgaagcccactatctgtactgacccttctttggtgaagacgtaatcatgtcgcttacgtagctgcgcatggtgcccacactgtagcaatccggccggaatggcacgaatacgaagatagaaagaacgagggcacacaggaacaaggccaaggacaacgcaaacccgcggactaccgaatgtcacacacataacagacggaacgacagacaaggacacagaagcagaagcacacacagagccagccaacgaccacagaacaggaaaaacacgaacgca

SEQ ID NO: 30 - DNA, 503 bp, Porphyromonas gingivalis
tgggtaccgacgacgacgacaaggccatgggataatacagagatattatcgaacatttggcagccgaatttgaggtcacggacgaagaacgcaaggaactcttggcaagtggctccaaagctgtttttgacaatcgcgttggctgggcaagaacatacctaaagaaggctggccttcttgattcgcctaaacgagcgattcttataatttctgaccttggcagagagatactttcgaagaatcccccaaaaatagacacaaaatacctaagacggtttccggcgtttatagaatttcagaacggttatcgaaatgacggcgaaacagaagaagaatccataacagaaaaaatacacgaacaaacacctgaagaggtccttgacaaagcatatcaaagaatcagaaaatcattggcttccgaattacttaataaagtcattgacctttcacctgctttttttgagaggcttgttgtcgaattattagtcaaaatgggatatgga

SEQ ID NO: 31 - DNA, 502 bp, Porphyromonas gingivalis
ctgggtaccgacgacgacgacaaggccatgggattgtgtgttaacacttcaaatgcgatcgccctgccggatggacgatatttgggactcgaatgggtagatattcttatatttgcgaccatatgagaaaatcactcactattaaaaatcaaaaacatagaatgaagaaaacgcttttgctcgctgcggtagttgtttgcagcagtttcgtcgtacaagctcaacagaagagtgcagacgttgtagagaatcagttcactactattaaagaagtgccaattacgccggtgaaagatcaggccaactcaggtacatgctggtcatactctgcattaggattcctcgaaagcgaaatcctccgtatgggaaagcccgaagtggacttggccgaaatgcactccgtagctcaatcatacaaggacaaaggcgagaagtatgtacgtatgcatgggaagctgaacttcggacagggcggttccttctacgatgttctctatgtggt

SEQ ID NO: 32 - DNA, 562 bp, Porphyromonas gingivalis
  misc_feature (152)..(152): N = A, G, C or T
catgagtgatgacaggaacgactttcatgagatcgaacgaatcaacaagtattgctctctctcaaaagactattcccctcgcatatcaaaaacacatcactacaatcaaacttaaacgggagcatttgaggcggtgtcccctgaggtctatnggttaatttcatctatgcagcaatatttttacatatctttgtcgcgtttcagttgaacatcttcaaagaacacattccgacacctttggacattacatacttctactatgatcctctaaacggtatacaatctcaatccaattagcctcctcgtctacgaatgttacttataaatcaaagtcattagcaatacaaaaaaatactatgatcgaccttttttcaaaattacgcaactcggattgcagtcttcggcagaatgctctaacactatgtcaccgcctgctgagccgcagctatctgctgtttttcctggcctttttacagcttatcgtcaatgaatcctatcgccgagtatcggtctcttggaatatggaggttcgatttgcggatattctgattgccccgatcgt

SEQ ID NO: 33 - DNA, 917 bp, Porphyromonas gingivalis
aagcaagcctagggattgatttatgttgaactcaaagaagtgagaaagatggcaatgttaagttattactcccatatatattgaaatgggaaggtggtttgtccatgatcctgccgatgcaggaggggcaacaaacaaaggtgtaacaatagcgacttggaaaagagtcggctatgacaaagacggcgatggagacatcgatgttgaggatctcaagttgctaaccgatgatgacgtcctgaatcgagtcttgaaaccattttattgggatcgttggaaagctgacttaatcgagtctcaaaaggtggctaatatccttgtcgattgggtttggggttcaggcaagtatggtattgttattcctcaaaggatactaggtgtgcaggctgatggaatagtgggcaataagaccttacaggctgtcaatagtgcagatcccgatgagctgtttgagtccatcttcgatgcacgtcgcgagttcttagaggacattacagcaagaagcataaaaaagtacgaggatcgcatcggacgcaaggccaccgaacgcgaatcgctaaggcataccaacaaacgtttcttgagaggtcggctgaaccgtcttgacgatatcaggaagctctaacgatccaatgctgcaggttcgtaccctgtccaagaatatctccatctgtcgaactcggttgggataacgccttcttggaaatctaagacggcgaagggtgcgccacatcgaatctgggaccgaaaagagcccgcgaaagctgagccgatcgagacacacacacacgagacgtggaccaccaagaagacaaggggccgaaaaaacaaaccgggacaaggcgagaagcaagaaacgaggagccaacacacggcgacaaccacaaccaacacaaccgaacaccagcaccgacgcc

SEQ ID NO: 34 - DNA, 501 bp, Porphyromonas gingivalis
ctgggtaccgacgacgacgacaaggccatgggatcgttgacgtgtactgaaaaaagttgacagttggcgggatgcaaccagtatccattatgggcaaacatttaaacaactttgaacgccttagcatccttgaggattacctctcggggtcagatagcaaagtagccattgagcagaaatatggtctaagtcatggtctcattcgctcttggcttagtaaatttggactcgaagataaagttcatccagtcccaatgaaagtgtcccaatccccccagagtgagctacccctgaacgaaaaagaagaattagagcagctacgtaaagaaaatcgtgtcctcaagagtcgtctcaagcgagaagaactagggcatcaagcctacaagctacttgtagagttggcagaagaaacctacggcattcagatacgaaaaaactccgaagccaagtagttcaccgtttatcagagccggagcctaggtatcctattgctcgactctg

SEQ ID NO: 35 - DNA, 1177 bp, Porphyromonas gingivalis
  misc_feature (45)..(45): N = A, G, C or T
tggccgcatgtttttgcatatgatcatcctgctccctggtcatcnttacaccaatgcagcttgcagtgatacttgtggtggggtaaaatgaatacgcttgtgttacctgggtcttgcttgtgcaatgacaagctgatccctcccggctgcagctgtgtgctatgccgttcctgttcgaatccatgctcttttcttgtttgcacgctgttctcattgccctgcatcattgcatcgcattctgcagtgtgcagcatcgcatgtgcaactgcagtgtgctgcagctcatttgtgtcagtccattgcctctgccatgcatgcatcagcaaagttgcatcagcaatccctcttttgctttctgttgccctttccatttcattgtcttgtgcaccaagtgccacattctatgcattacatctgcgctgcatccagtgcatccagctgtgtatttcattcttcatcatccatacccaattcactcataactaccagacaaactgcaaacctgtttccatgtcctggaacaatgccattggcaacaacagcatatacattggcaatgagacacccgatttggcattctccattcactgcaaacatgccctttgcaaaaacactatcgtttgcgctctccatcaatacacacaacacacatatgtccatcatactcttgactccaaccaccactcatatacctacattccctttaaacctaatataacatatcccccacacatacatctaccacaaacaatgcacatatcaaacaccatccagataccacccacaccccaccccttcatctacactctacctttcccactccacactccagaaaacactacacaaagcaccaaccacacaggcacaagtaccacatacaccaatagtctgcccgacaaacaccaaaaagaatcgtccaactgacaaatacccaaccacactactacacaccatgacaccaacaaaccaatcatcaaaaaacacctcacaacacataaaatcacttacatatcaccaacaccagaatctcctctacatacatctaaaccacaaacaacctaataaaatcaacacaaataataacacccctaaacagtctaaaattcatacactcaaaatatactacatcacactacacatcacaccaacaactattcatactatcacttcacaacaa

SEQ ID NO: 36 - DNA, 767 bp, Porphyromonas gingivalis
acgagaagagccatgctagggatacttcggaacgtggggctgcaagtgggactgtgcccgagatgcgtcagtggcatgaattttggaaatgaagcatacggcccgagaaacggttacgatcgctttggtgggtaagtatgtggagcttcaggatgcgtacaagtccatagacgaatcgctgatgcaggcggctatatataataggaagaagctgaacctcatatccgttcacagcgaaaaggtgacggaggctaacgtagccgagaccctgaaagatatggacggcatcgtgatcgcccccggattcggttccagaggggtcgaaggcaaactcatagcactgaaatatgcgcgtgagaacgatctgcccacactgggtatctgtctgggtatgcagtgtatggtgatcgaatatgctcgcaatgtattgggcttcaaggacgccaatacgacggagatcgaatccaatatcgagcacaaggtcatcgacctgatggacgaacagaagacggtcacggatatgggcggaaccatgcgtaagggcgcatacgactgcgctctgcgcaacggatcgacatcggctgctgcctaaggccaggcatacgtgcgcgaacgccaccgccatcgcgacgcacccaacagcccgcatcgcgacgacacgaaccagccggatgaaagcgagggcgagacccgaagacggcttggcacacacgacgcatcctagctgcgcagaaacgcggaaacaacccccccccaagaaaccgcca

SEQ ID NO: 37 - DNA, 907 bp, Porphyromonas gingivalis
ggacccatgctttggatctgcggatggcgcatgcacgccgtttaggcttcgcgcctctccgttcgcgagcagcaggagctggcagctctcggcatcacggaggcctactacgacctcgtctatgcgcgccaaatgcaagagctggccatgcagaagtacgaggagagcagccgcctccaccggcagacggctcgaatggaagagctggggatgaagagtcgtcccgatgtcctcgagatgcagtcgcgaatggccggtgaccgtttggccctgactcaagcggacaatcagtgcatcatcgctctgatccggctcaaagaaaaaatgaacttccccatcgatgacgaactcgtcgtagacgatatgccggctgacagtctctccgccgacatggccgaatcggacagctcggccggcgtcttcgcccgtgctgcccatcatcatcccgtcctcctccgtgccaaactcgacgagcaggctgccaccgaccgtttgcgagccgcgcgaggtgcattcctgccgagtgtgtcggtatccggaggatggaacacgggattctcaatctgtggatccgaattcgagctccgtcgacaagcttgcggccgcactcgagcaccacacacaccaacacttgagatccggctgctaacaaagcccgaaaggaagctgagttggctgcttgccacgctgagcaataactagcataaccccttggggcctctaaacgggtcttgaggggtttttgctgaaaggggaactaatccggattgcgaatggacgcgcctgtagcgggcataagagcggcgggtggggtacaccccgtgacgtacttgcaggacaaggcgacattggataaccgctttccaaatgcgggtaccgcaacaaagggacacagggcacatggtgg

SEQ ID NO: 38 - DNA, 669 bp, Porphyromonas gingivalis
ataaacattgtagatacagccgcttccggtcgctctcttcttttgccttttgggagctgtgcacttgtctgtcgaggcgcagatgctcaatactcctttcgagctgtcggatcagatcgtcctgtctcccaccgaaaggcaatacagggagatttgtgtgcaaacgaaagaaaaaaggggggccgatcttttcccgttgagcgataagctgcgcgattcggcctatgttcgtttcggctcggcctatggcgatattgcgggcgactatcttccgtacaacggcaataactactcctcgctctcgctcgaatcgggtggtcgcatcagtgtccgtaactatggcacattgcagggcagtgcttcctactcacgtggcatgcacaaacgcatcggctggaatgctctgcgcaacgccgaagcctactatccctatttggtgtccgattcgaccggcggagactatcatttcgaagactatcggcttgccggctactattcttttcgcgccggccgcttgcccctcggtataggcttctcatacaggggcgaagttgcttatcggctgaccgatccgcgtacgaccaatacgaccggtgcattggaatctgtggatccgaattcgagctccgtcgacaagcttgcggacgcactcgagcaccagcatcaaca

SEQ ID NO: 39 - DNA, 839 bp, Porphyromonas gingivalis
tgtaacactgaacccgacgcgtactcgatccatatcagtaccatactcccataaccggatgcgacgcatcgtgacttgtgtacttcttgccgtgcttcgaatgtgaactcgtcataacgtgcaggctggttgcctccatctcctgcgatccacatctttccggatgcaggttccgggttcgtacctgcaactacgtcgtaccaccccccccggggacttacccacttccccctgtcctgtacacgactaatacttctgtgtacgtcacaacaggactcggattggccgggctcacactactcgaacgttcgccctgtaaagatcggacacgcagctgttccggtaacagacgaggacccggttgaccggacctgacacttccgaatgtatttgtgactcggcacttcccccaagacccttggtacccccgttattgtctccccatacgtcgtctgctgcgacgcaacacccttggctatcgaaggcacgtacatcggaagccaaagtcccgaatcaggtcccagaaaagaccgactccgactccgtacaaccacaagagaccctcaagactacaatgcgcccggaggcaacccaaatgagaacacagccaccgacacacggcgcgactacaagatccaaccggctgccactgagagaatacacagacaaaaaacacctaccaaccacccacgacggccgccaccaccatccagacaaagcaagcctgacgacccacccgaacaacacgcactcggtcaccaccaccccagaccataccaaccaacggaacacacagaaacaacacaaagacacaccacacaacccccaccgagtccaac

SEQ ID NO: 40 - DNA, 226 bp, Porphyromonas gingivalis
tgggatgacctacacaaactcccaattgctttagcagatacaactgcaacagccttagcgattttcttgaagaaactccagatacttctattgttcatcgaattgcccttcaacagaaaaagtttgttgacctgcagagtatgtactccggccatcactatccaaagagctattataagtttctaaatctaaaacaagttcagctaaggcaatgctgtcttcgatt

SEQ ID NO: 41 - DNA, 346 bp, Porphyromonas gingivalis
atctgggtaccgacgacgacgacaaggccatgggatatcaacagcaagctgcgcgaaatcctcgacgaagccaccaacaaatggggcgtgaaggtaaaccgtgtggagctgcaggacatcaatcctccgcgtgatattcgtgatgccatggagaagcagatgcgtgccgagcgtgacaagcgtgctcaaatcctccaggccgaaggacagatctgtggatccgaattcgagctccgtcgacaagcttgcggccgcactcgagcaccaccaccaccaccactgagatccggctgctaacaaagcccgaaaggaagctgagttggctgctgccaccgctgagcaataa

SEQ ID NO: 42 - DNA, 897 bp, Porphyromonas gingivalis
gacgacgacaggcctttgggatctatgcgtagggagcgattggtatgccacgcatccaataagaaaagcagtgccaaaagtaacaaaggaagcaatgaccatggacaaaagaactgtccgacagccagtattacagagcctaacgtaaagagggccggcagtatgtgtacgggcttcatactcccgggatgccgtctttgcaaatgaatacgggcaataccggagttgtacacctgacggaagaacttcttaaaatcgattcgccgtttatggaaaacaaaggcttccggaaacaagcatacgttgtatccggccttaaagagacgcagactaaaatcaatatcttcaccgaagcgcatctcttccgaaaaaccaccgagttgccgatagaccgaaagtttgcagccaaaattgaaactgcgaggatagaacttgtccagtcgtactcttctacccccacgaatgcctccggtcgtgaagaaagaggtcatcgcatagttaatggctttttgtatgggtgagaatccttctgctgctgcatcagggcctgcgaaagcatctgcttgcatctgttcgatcctttttattactgcggctatataaccgctcggcagtactacatccgagtccaatatcaacagatattcgaccacaggcattcgtgcaccaatgttgcgcgcagcaggcggtactccattcggcactcttacatactgtattcggagaagtctctgacgcgatcaattctttgtcgcagacaaagacgaaccactctacgaagatccttcaagtggtatcgccggatagcagaactcagacgtccgactagcggggaaacaccgggggacaaaggaacgggggggctcaccgccgaattgtagcaacatcaaggaggaa

SEQ ID NO: 43 - DNA, 1459 bp, Porphyromonas gingivalis
  misc_feature (35)..(35): N = A, G, C or T
  misc_feature (229)..(229): N = A, G, C or T
aaacataacatcaaccaaccccgttttctaaatcnatcacgcgtacctgatttagtgcgttctacaccacgagctatgcacacggcttcgggttatgcatatcatcatggttggaaccagaacgggtgattatacgcatatatgaataaagtcatgcgcacatcaatgatagactagacatacaacagtcaacagaccacatccatacgagcatcgaacacgacgctanagaccaccagacatacacacacgcagtcactcatacacataaacctaccaatgcatcactatacaatctacaacaacaacacaccaacattcacacccattaaacacactcctgtatccctttttacttttgtacaaatatctacacactatatacaccacaacaaatcttacactaacagatacaaccatcagaaccatacttaatgataaaaccaacatacaaaatatacaaacctaccactatactataaactctcctctcaccatccataatctataacacaaatctactaatacctagatcaaataacaacaactacaaactctatagtcaccatcctatcttattcattatacattattaatttaattcttactctatgacactcacctacattaatacctatatctatactctacatcacaacaaaatctacatccatacaacctaaatattctatctttttatctcactcccatcacacttactatacacactatacttagaaaatatatataataacatatcctaccaatctccaacatcatcagatcaaaaacaacatcacatcttctaacccacacatgtctatacaaccccctcacaaactatctactacctacctcatctaatctcacattactattctacacaccatatctaacactacacatatactacatatccatacactccaccacaataacatattcaactcacactatgacccaaatacatgataactaaatcagccaatcaaataccgactctcctcgttatatctcttcactacaactatgaacattgttagagtcgtgacgctgccgctgcgtgatggtcgcaagctacgccggatccagaataaggatatcgctgggaatagtcagcgagaggctgagtgcagatgcagacagcgtagcccagcacccacgccgtgagacaggcacagaggcgatctcgcacgcagacgaccagtggccactaaccacaagcgcaatcaatgagcatacgaagagccgcacagcgtcacgccaggacgcagagagtacatacgtcggatagcagcagcacagccgaacagtatgagaaaaacagcaggcagccagcccgcagcgaggaatgacagcggccgctgactcccgaactagaagcacatactgacggtacagtgataagacgtaacaatgatataagcgccaactcgacgtactacagggccaggcgacg

SEQ ID NO: 44 - DNA, 792 bp, Porphyromonas gingivalis
tgggatatactatccgctacaggtattctcatcaatgagcttgcaggatacttgggggggtaaaatgaatacgcttggataccgggtcttgctgtgcaatgacaagcgatccctcccggctgcagctgtggctacgccgttcctgttcgaatccatgctcttttctgtttgcacgcgtggctatgcacgactattgatcgattcgagggagatcgaggtgaaggagggcgagctatttggtagtcattgcctctgcaacgacgatcagaatgtgactagaactcccctcttgctttctgtcgcccttctcactttatgctcttgtgacaacgtgagacttctctgcgtttactccgcgcgactcacggaatcacgcgtgttttaatctcctcatcgatcacataatgcttcacacatgcaacgaaacctgttcctgtcctggacacgcattggacgaaacgacttttcttgactggcaaccgttgtggatctcactcctgcaatgccccttgcaaaactgggtgggctgtcactcacggacagacaatttgtccatactattcttgcactcagctcctctactattctacttttctctgaccgaatattgatttgcctgacagaaggtccgacgaagtgacttgcaatgctacaccagtgtctggagcactattttgccgcagactttcttgctcctccgtctccgacgcatcacaagagagcagcatacggtcaagttctatgcagacaggctgtgcctcaggtccaaacatttggcactgacgataaaga

SEQ ID NO: 45 - DNA, 1156 bp, Porphyromonas gingivalis
aaaaaagaagaaaaacacaagaaaaaaacgtacatgcatccaccaccacgtactcgtatccatcataaccgatcagctccggtagtaacaccataaaaactatacacaaacaaaacacaacaaaaacgaaagaatacaaccaaaaaagaagggataaaaacacaaaaacaaaaaacacaaaaaaaaaccaaaaacaaaaacacacaaacaagcacaacaccaagccaaaacacaccacaaaacaacaaacacacaaaccgacacacagaacagacaacaaacacaagcaacgaccaccaagcgcgacacccacaacgaccacaccagccgcccgcggaccaacagacaaccaacgaagagcccacacaacacaaacacaaaaacgaacaaaaacacacaaacacaaaaagaagaaagagacaagcgacacgccgacggacacccccgcaacaaaagcgacaaacagaggagaaaaacacacgagacggacggacaagaacgacacgcagcgaagagcaaaagcagaacaagaaacaacaaaccgcccaagaagagaaaaagccgacacagccaacaacagcaagcaaccgcaaccaacacaccaaacccaaacaaaccagcgacacccgcagagcacgcagaagacaaacagacacaccacaaaacaaaagccgcagcagaaacgcgacggacagcgaccgaacagagacgacacccagacagaacgaaaagaaaaacgaccaaacacaggccacgaaaggccaaagcaaacaacgaccacagcaacgagaaacacaacaccaaaacaaagaacacgcaggcagcaaagcggacaaacccaagcagagaaagcgaccacaaccaaaacgccaagaaaggccccacaagccagacgaaccacccacaaaaacgccaagcggagaacacagagacacgccccaacaaaagcaagacaaacaagaaaccacgcaaccaaccacgagcgcaaaagacagaacaacaaaaagacaacagcagaacagacaagaaagcaaccacccaagacacaaagaacaaaaaaaagaagacacaaagaaagaaagaagaacacaacaaggcacgaagaaaaacaagcacacaacaaagacaccaaacaacaacaagaaaagcacacaac

SEQ ID NO: 46 - DNA, 821 bp, Porphyromonas gingivalis
  misc_feature (711)..(711): N = A, G, C or T
aagacagcagcatggctggatgccccatgttatgatatcacacactctctactctgacattaattgacatttaatgcaagaagaaacgaatgcgttgaaatcgcgtctctctcttccactattgctactcgatgcaactcctcgaccctgaagttgtactgttactcggcacaatgcttttcagtacatgtcactgctccaaaatattcccgtttgacactcctaaaaacatggtgtgggaactttatggttatggtgctgtgaaagaaaaaaattctcatgccacaatgaaaaaaatctctgttccattttatcacgaaaattctgacactaaaatctggtgcattttttgtgttctggatctgactgacgatcttgtgtcatcctgaactacagatgcatcctgtctgacacaatgatatgctatgcactgcacatctaatgaaaacacgcacacatccaaacacaaagatgatcactgtgatttgaatataaaacatgccatgacaatcggaaagattgataaatgaccttgaattgaccaccatgaatgaacacaacataacatactcaaacttataccgccatatgaaagagacaacaataaaagatgagatataacgatacgtgagtccatacaagctatcaacatagacaggaaacaaaaactcccgcgaacatgacacacaatagcaacagatacccaatgtnaaaatacaaacaaataacaaaatccaacatgcgagacttctaactaataaaacaactaatcaatataaaaaaacgagcacatcaacagcacacagaagaccaaacacaaa

SEQ ID NO: 47 - DNA, 307 bp, Porphyromonas gingivalis
  misc_feature (242)..(242): N = A, G, C or T
  misc_feature (255)..(256): N = A, G, C or T
  misc_feature (259)..(259): N = A, G, C or T
tagagcgcacgcgacaaagaccagacaaagataagacagaaaaccaagcgacatgaacagaagagaaacaaaacagagaagaaagagcaaaagtcacagaaacagaacaggctacgaagagcaagcaaacgagatacgacagcaaacgaaactagaagcgaatgaacagaggacagaatcgaagagaccacatagcatgactagcagcaagcagcgaaacacgtcttggcatgaggtagagngcccctcgtggtnntanttatgagacaagaaacagagaggaaagccctccttggtatgtttcata

SEQ ID NO: 48 - DNA, 2128 bp, Porphyromonas gingivalis
  misc_feature (30)..(30): N = A, G, C or T
  misc_feature (33)..(33): N = A, G, C or T
  misc_feature (38)..(38): N = A, G, C or T
  misc_feature (49)..(49): N = A, G, C or T
  misc_feature (89)..(89): N = A, G, C or T
  misc_feature (92)..(92): N = A, G, C or T
  misc_feature (109)..(109): N = A, G, C or T
  misc_feature (116)..(116): N = A, G, C or T
  misc_feature (196)..(196): N = A, G, C or T
  misc_feature (225)..(225): N = A, G, C or T
  misc_feature (394)..(394): N = A, G, C or T
  misc_feature (2128)..(2128): N = A, G, C or T
acacaccgcgaatgactagcagctaagatngancctcnccggggtttcnatttcagcatgcttagctagcagaatgaagagaatctccncgngggtgttgttcaatttncaaagtnatggtatgacatcgtgcatcacgacgcacaacatcagtcagctgacggacacagaacagcctcggggtgttgtatctacnttgtatcacacaacacgggtgtggtatcnacatacacggagctatcgagcaactcacagatacaaattaattagaacataagagacagtaataatcacatgacgcaaactgatcacaagatatgcatagcatcatcataagaaacaacatacaacagatacgcaaaccgcacagcacacgacaccaacagacagacancaagtaacgacatagacagcgacagcgcacatcactaacacgtacacgagtgaccaccacccaccaacagagaactaagactgagcagagacgcaccacaactgactagtaaataagtaggagggcacagacggtggcataagccagaacgcacaccacacacgaaaagccgacaaaaacatactagcaagtatgatcgatcggacgcgcccacaactagaatgaaaacgaaggacaacaagacaaagacacacgaacgcacgcgacacaaggagaaggcgaagacacagcacgagcagagacgagcgagggagagaaagaatagagtagacgtctagctaggagcaccgacagcgccgcggagcggacacatcacagtcaagcgcaaatgcgcgctccagacatctcgagcactcgaacaggcacagctaggataggtagagcaaatgcgcaagaagaatggagtagacgagaagagacacgactagacgccactacacaccggcagatgagaggagacgaagatcaccgctagtatacagatgccgagagggagagtgagagtcgggctagcgatcgatcgtgccagacgcaaacagtcgcacgctaatgacctacagagcgtacgcgaagagtacgacgaggagagtaactcagcaggactcgacatgaggacgactggcatagacctgtgaccacgcggatgacgtaactcagtaggcacatgagaagctacgacgatcgagacagactaggccagagtcagaggcatcacgtctcggacgacggagatcagcatgaaggataccagtagtgagagtatcgaggctgccagacagtagccaggagacacagcgcgctgcagaagagacgagtgacttacagagagagaggacagcacgcgagtagctagtctacatagtgagatacgtacgagacagcaaggtacagcaaaagcaatgagcagcactgtagcaccgacgatagctcgatcggatgcggagcacatcgctattcagctggcggatcgtaaatacggagcatataagtagcgaggagtcaggaactagtgagacatactgatagagctactagagtgagccagtacgcatggcaagaccaagtactaagagatatcgtcgagcgagagactgcgaacgataacgagagtgaacagccatgaagtacgccgtgactcacgctacgaccgaactacacgcggagatgcatgtcataccgacacgagcgagaagactaggcgatcgatacgagtgaccaggacaggtgataggagaccacgacacgagtagagagggacagcacgcgatgacaagctaatggagagagagcacaagagcaacggcagacgcgcgacgcagacgaggtacgcgtgagcgcacgcacgctgaatgctgcagtaggacgcacgctacggagcagcagacgactcgagacgacagcgtacgcagagaagcaagcgatacgagtggagcaacggagaagagtgacgatagcagtagtcagcagcgacagcatacacgatacaggcacgagaacagagcatgcatacggtgcgacgacgggacgaccacataagagccggatgagggacctacaccggcagcgatgctagacgacagagcagagagagagcggagtagataagcagagactgagcagacagcacaacactcgagagaaaacacccacgaatgaagcacgaggtgacagcgn

SEQ ID NO: 49 - DNA, 829 bp, Porphyromonas gingivalis
gagagagcaatgcttgggatgtctctccggattcgctccgtatcgacttctttgccggtagagttgatcatgaaaccggatggctcaagcactataagattaccccttcgcacgtccaattcatcatcgaacgcattcagtaagcagcaatgattaccattgggatcaccggcggaataggaagcggaaagtctgttgtcagtcgtatcctgcttaccctcggtatccccgtatacgactctgacagcagagccaaatggctcaatgatcacagccctgtcgtccgacaggcactgacgggcctcataggcagcgatctgtacgagaacggcatactcaggcgagacaggctggctgcggctatcttctcctccggcgatctcctcgaacaggtaaccgggatcatacatccggaagtcaaaacagacttctgccaatggcgtacggagtgcgaatcggatctctgcgccatcgagagtgacattcttttcagctcgggattcaactccctgtgcgatacggtaattcgggtcgatgaccacgaaacgataagacaagagcgggcgatggctcgcgaaggatcatcggaagaaaacatgacgcagagtatgctcagacaagaaagagagcaccattggccaggacgcagcagaccaaaggtgacacagcacaacccactatcgtccgcagtggccgactaagagacagacgaacaagaaccaaacgccaaccgaacaaggaacacaagcgcaccggtacacaccccgcacgaccaaaactcaaggaacaccaacgaaaccccaaccacaccggcacaccaagccggaag

SEQ ID NO: 50 - DNA, 530 bp, Porphyromonas gingivalis
agggaccccgggttatgatggatcagtttacgccgctgattttacgatcgccatgcaggaagccaaggacattatcgcaaagctcatgtagcatttcgacacgaagaatcataagtttgagtaccgacatgaggcgttaagctgacattgtccatagcaaagagttcgggagaaggaatatcgttattctcgaagacatcgaggccggcagtggcaatacgcttatcacgcagagcctcaaccaaagctcgctcgtccactacggtaccacgagccgtatcgatcaggatggctgtcggtttcatcatggaaagctctgctgtgccgatccaaatgtttcgtttcgggagtcaaaggcgtgtggagcgaaagaacatcagcccggcgaatcaactcgtcttcgtcctgcaaaggtgatcacttgagcccttttcctctgctatcgctaaaatcgaagtgcgtaatgtagtagcagaacactccatgcacaaaaacgcatttgccatcgaaagttgccaactgcaaggacg

SEQ ID NO: 51 - DNA, 847 bp, Porphyromonas gingivalis
ccggagagccagtttgggatgcaaaaggcgagatcatcagaagtccaaacaaacgaacagaccctatccgaactcgaacaacacttcgccgtcgtaaggataaaacgaccagggtaaagcggattcgccccttggggattactccttcaccaccgcctcttggaggaatatccgcaaaccacctcttccgaaacacgtaccgcaaacgctccgattccggtgcgtgtttgccgaacaaagtggcgcgagatttttttcgttttggctcgtaatttttttacttcccacgccaaaacgaaaaagttctcgcaccatgttttatggcgttataaacaggaaaattttggcgcgtaaaccaaacgaatccgagattgacacattccacactctcgtgcagcgttcgtccgggaaaatcgtctacccacaggctatctgtttttcagttgtttatcatttttaatctgtgggaatccgcatacggttctcaagattgagatcggaaaaacacatcaaaataagtagcagatatgtggaataattgctatattagcataaacaacactccgtagaggaagccaccaaaacgacgatgagttacctcaaattcgacaaaacgctcatggcgaatctggatgaatcgcttcagcgcgaatacatccgcaccaatcgaacaggcgcttataccagctctacgatagtaggctgcaatacccgtaactatcacggtccgacggacgacccaaaccgagctggggacagacatcagactgggcagacaggcaagaccaaaccgatggacagcacaagagaggacagggaccgaacaaccaaaaacagcggccaccaa

SEQ ID NO: 52 - DNA, 677 bp, Porphyromonas gingivalis
cgccgagagagcccacgtttgggataatacagagatattatcgaagcatttggcagccgaatttgaggtcacggacgaagaacgcaaggaactcttggcgaagtggctccaaagctgtggttgacaatcgcgttggctgggcaagaacatacctaaagaaggctggccttcttgattcgcctaaacgagcgattcttataatttctgaccttggcagagagatactttcgaagaatcccccaaaaatagacacaaaatacctaagacggtttccggcgtttatagaatttcagaacggttatcgaaatgacggcgaaacagaagaagaatccataacagaaaaaatacacgaacaaacacctgaagaggtccttgacaaagcatatcaaagaatcagaaaatcattggcttccgaattacttaataaagtcattgacctttcacctgcttttttagagaggcttgttgtcgaattattagtcaaaatgggatatggaggttctatcaaggatgccggtaaagccattaggcaaaagtggagacgagggaatcgacggaacaataaaagaagataccctgggacttgatattatttatctccacgccaagcgctggcaggcctgggaatgtggtaggaagcactgagcttcaaacgtcagctggagcactcgctggac

SEQ ID NO: 53 - DNA, 798 bp, Porphyromonas gingivalis
cggacgagagagcccccgggtttggatggtatagcttgcaggcgaagctggtatcacttccatatcagttccatctcccattccggcgcgacgcatcgtgaatttgtacttcttgccgtgcttcgaatgtgaaatcgtcataacgtgcaggctggttgcctccatctcctgcgatccacatctttccggatgcaggttccgggttcgtaatgcaatagtcgtaaacaccaccggggattacaacttcaccctgtcctgtaacgataatattctgtgtagtaacaacaggatcggcattggccgggatcaaatactcgaagttcgcactgtaaagatcggaagaagctgttccggtaaagagaggaccggttgccggaatgacacttccgaatgtattgtgatcggcatccaacaagaactggtaacccgtattgtctccccatacgtagtctgctgcgagcacaaccttggcttcgtaggaacgtacatcgtctgcaggttcgatcgtaacgaaaagaccgtctccgatccgatttacttcacgagaaccttctgtcttctttgcgctcggggcttcccactagagaaccaagtcgccgacaaccggtagcgccttcaggtacataaccggactgacggagtcgaaatcacagaacgtacaccatcccaaggagatacgccggagggcacaccatacacgcataatcagatcgccgaagcccccccatcacgaaagcgacaggcaaacaaccgatcacgaccccaaaaaacggacgaaaaagaccgagagggccacag

SEQ ID NO: 54 - DNA, 923 bp, Porphyromonas gingivalis
ccggttatgggatctccttcgccttgccccaagaggtatagcacggcgagatgcagcggtactcgccgtcaaccaagctctggtcaattttaatctaaatatgaggagatcggctcgagctactgaggctaaggcaatcatcgaccaaatgaaagagatgccgatggaggcacactcacgtaagctactggcttccgctcgcaaactagtggataagggaaatccagatattattaagcgcataatcggcatcggccatctcctcaaagagcgagaggggtctttactgcctattacacaggatgagatcgatacgattattcacaaagaaatagagatattggtctctggcatcgccaagaagtttggccaagccgaggtgtttattggtttatcactataacgattgtacaatggaactgaaacaatacttacagcagtcttatcagggcatcgagtcttttctggagaaaatagtcttcccaatctttggtcaagagctatttgaggaatctgtggatccgaattcgagctccgtcgacaagcttgcggacgcaatcgagcaccagcaacagcaccactgagatccggctgctaacaaagaccgaaaggaagctgagtaggctgatgccaacgctgagcaataactagcataaacccttggggactctaaacgggtctcgaggggtaacacgatgaactgaggacacataccggatggccgctgcgacgcgcccagagaggagcataaagcgcagagggagtgagggacgcacaccggaccggaaacagacaaggcataaaccgcgacaacaaaaaacacacaaacacaagaagcgagaaacagaaagacaaaaaggaaccaaaagacaaaaagacacggcccacaacaaccaacaagcagaaggcaacgacaatcacag

SEQ ID NO: 55 - DNA, 619 bp, Porphyromonas gingivalis
tgatctgaatagccatcacaatatccctcaggccaatgaggtcgtggagatgctccttatacttttaccattctcagatcttcttccaccaagatcgaactggtgaaaatgtccatcgacgaccaatcgaactaaaaaacaatcagttgaaaggcttggcattttgaagccggtttgtatctttgtggcttaataaacacattcttaatagtgcataataaatagaaaacataataacaaaatggcgacattagagaaaatcagaggtaaagccggtttgctcatcgtagtggtgggcgtggctctttttgcctttattatcggagacttccttcgatccggatctactttcttccgtcagagccaagaagtagtcttggatatcaacggagagaaaatcaaaatctacgattaccaacagcgtctcaaagcgatggagaaacgcgccgagcaaagtggaacaaagatcaccgaagaacagcgtgcttctctgaacaatcagctcgcacagcagtatgtacaggactacgtgctcgggcagcaagctgacaagtagggtcttacggtaagtccggaagagctattggctctgattatcggcgatggtgttcagacctcg

SEQ ID NO: 56 - DNA, 750 bp, Porphyromonas gingivalis
  misc_feature (179)..(179): N = A, G, C or T
gacgagagagccatgcttgggatacgattcgtccgttcgtcctcagcttagaagaagaggagaaaaccggcgtcaaggtgctcaaggctgtcggaaaacatgttcccagacatgggcttccgcattcaggtgaacgtaatggactgtctcggctgtagcaactgtgtggatgtatgtcncgggcaataagaatggcaaggctctgaccatgcagcctatcgaggagcagtacgaagaacaaaagaactgggataagatgatctccggtgtgaccggcaaggctcacttggtggacatcgcagccaatgtgaagaactcgcagtttgcgacgccgctctttgagttctcgggtgcatgttccggttgcggtgagactccctatgtgaagctgatcacccagctctatggagaccgccagacagtggccaacgctacaggttgttcttccatctactctgcttcggctccttctacaccttacacgaagaacgagcgcggcgaaggcccggcatgggccaattcattgttcgaggacaatgcagaattcggtctcggtatgcacttggcatataagaagatgcgtcgccgccttgtgaatcttgcagaagaagctcagcagtctccctgctgttcggacgagctgaaagctctcttgagagaatgggtagaaaagcgtcaggatgctgtcgacagcaaagtcttgccgatatctgtggatccgaattcgagatccgacgaccagcttgcggc

SEQ ID NO: 57 - DNA, 2271 bp, Porphyromonas gingivalis
atgcggacaaaaactatcttttttgcgattatctcttttattgctctattgtcgtcttctctgtcggctcagagcaaagccgttttaaccggtagtgtgtcggatgccgaaaccggagagcctcttgccggtgctcgaatcgaagtcaaacacaccaacatagtagccggtgccgatgccggcggacatttcgagatcaagaacctgccggcagggcagcatactattatatgttcgttgggggggtatggacagaaagaggaggtggttgccatcgaagccggacagaccaaaacgatctcttttgcattgcgactgcgaacgaacaacttggaggaagtcgtcgttaccggtaccggtacacgttaccgcttggtcgatgctcctgtggcaacggaagtccttaccgctaaggacatagcctctttctcggctcctacttccgaggccttattgcaggggctgagtccgtcttttgacttcggccccaatctgatgggctctttcatgcagctgaacggccttagcagtaagtatatcctcatccttatcgatggtaagcgtgtgtacggcgatgtaggcggtcaggccgatttgagtcgtatttctcctgatcagatcgaacggatcgaactggtgaaaggtgcttcgagttcgctctacggatccgatgccatcgccggggtaatcaatgtgatcacaaaaaagaatacgaatcgactgagtgcatatacgtcacatcgcatatcgaagtacaacgatcggcaaaccaatacttcgctcgatataaacatcggtaagttcagtagcaataccaactatttcttctaccatacggatggctggcagaatagtccgttcgaaataaaaaagaaaaaaggatccggcgaaccggtcttggaggaaacgtataagaaaacttttcgtgcacaggaaaatcagggtgtaagccaatcgctttcctattatgcaactaacaatcttagcttcagcggaaatgtgcagtacaataaacgtcagatcttcactccgactttttccgaaaagaaggcctatgacatggattatcgtgctttgacggcttcactcggtacgaactatcttttccccaatggtctgcatacgctttctttcgatgccgtctacgatcgcttccgtttcggatatttgtatcatgacaaggacagcagtgagagcctgatcaacaaccaaggtcagaccgagcaacccacattctttccgggtcagctacgcaataaaaacgatcagatccgatacacggcagaggctcgcggtgtatttacactgccttatgcgcagaaactgaccggcggtttggagtatttccgtgaggaattgatctctccctataatttgattaccgacaaggcagatgcttccacgctctctgcttatgtacaagatgaatggaaaccgctcgattggttcaatatgacagccggtttccgtctggtacaccatcaggagttcggtacacgaatgacgcctaaggtatccatactcgccaagtatgggccgctgaacttccgcgctacgtatgctaacggctataagactcccacgctgaaagagctttttgcacggaacgaactcaccactatgggttcgcacaatctctatctcggcaatgcggatcttaagccacagatgtcggattattatgctttgggcttggagtacaatcaaggccctatctcgttcagtgcaacggtttatgacaatgaacttcgcaatctgatctcctttatggatataccgacctcacccgagcacgaagctcagggaatcaagaaaaccaagcagtatgccaacataggaaaagctcgcagccgcggccttgatgtcctatgtgatgcctctatcggttggggtatcaagttaggagccggatacagcctcgtggaagctaagaatctccagacggatgagtggctggaaggagctgcacgtcatcgtgccaatgtgcacgccgattgggttcactactggggtcagtatagacttggcgtgagccttttcggccgtattcagagcgagcgttactacaaagacggcaatgctccggactataccttgtggcgactcgccacatcgcatcgtttcgctcatttccgccacatcatcctggatggaacgctcggtatagacaacctgtttgactacgtggatgatcgtcctatgggtgtcaattatgctaccgtaacgccgggacgtactttctttgctcaaatagcgattcgattcaacaac

SEQ ID NO: 58 - DNA, 733 bp, Porphyromonas gingivalis
gggatacggtgatttcaacgtgccatgtaacgttccctcattccggctgtatttatgtcgacggcaacggcaagatagtatacaaccatactggttatacagaaggcggagaagccgagctaatcaaaaaagttcgagagctggtgaagtaatagcagctcccacaagtggttaatttattatcatatagaaaagactaaaagtattatgatccgcaagttgatcttactgcttgctctgatgccggtagcctctgtggcttttgcggtaccaacggacagcacggaatcgaaagacaatcgtatccttacaagcatgcaatcctcctctttgaatagggatgatgctccggataaatggcaacctatgcatgccaatttcagtattcagagcgatatgctgctttctactgcccaaaagtccaagaacacctggttcggcaactcctatatcatgggtataatcaagaacaattatctggagtttggtgcccgtttcgaggatctctataagcccctgcccggacatgaacccgagatggggcgtggcgttcctcacatgtatgtgaagggaagctatcattgggcggagctgactatgggagacttctacgatcagttcggtagcggtatggtattccgcacctatgaagagcgcaacctcggtataaacaacgcggttcgcggcggacgtatagtactcactccttttgatggagtgcgtgtccagggta

SEQ ID NO: 59 - DNA, 784 bp, Porphyromonas gingivalis
gagacgacgacaagggcttgggatatagcgacacaaatccgaaaaacataacctatcacataatccgaaaaatgaagtatttccaagaggcagatattgccgtgaccgtctgtgacaaaacgggcaaaatcatcgatatgaacgaacagtcccgtcaggtaaacctcaagccaggtcaggagctgatcggctcgaatgtattggactgtcatcccgaaccggctcgctccatgctcgaagagatgatgcgtcaggagcgaaagcacgtctatacgatagagaagaatgggcgaaagaagctgatctatcagatcccctggtatgaaaagggggaatatatgggcttcttggagctgtcgatggtgatccctttcgaaatggaacacaagattcgtacaccgaagccggcaaatgattgagactccttatatataggaaagctctgttcctttccgacgaaagccaagagggtgttgcaacttttgtcttgcaacaccctcttcttttcctatggatcatgaccacaggctaaacatctctgctgaaatagcaggcattaagattctaccgatatatattagaatagaagggcctgcctatacatatcgcacactcgagaaggactcctccgaaaggtttgctatgataaagattttgtaaagcttacaaagggcaaaaccaaagtatatagtttggtttcatcaaagtatatagtttggttcgaccaaagtatatagttcggtttgaccaactatatagtttagtcaaccaaatatatagttag

SEQ ID NO: 60 - DNA, 687 bp, Porphyromonas gingivalis
ggatcccttcgtgagcaaggtgctcatgatcaactttatcgaattggccacacgtatcatgctcggcctgccggtagataagccgaacaagagcgagttcgatctggactatgtcggtatcaaggcctcgcagttctccttcacccgcttgcaaaaggccgaccctgtcttgggtgtggatatgaccagtaccggagaggtaggctgtatagcggatgatacggacgaggctgtactgaagagtatgctttcggtaggctatcgcattcctcagaagagtgtactcttatctaccggaggctataagcaaaaagtggatatgcttgatgctacgaccatgcttgcagccaaagggtataagatctatgccacggagggaacgcacaattttctcagagagaacggaatcgaatcgaccaaagtgttctggccgagcgagaacggacagcctcaagctctggaattgcttcacaatcgtgagatcgagcttgtggtcaatatcaacaagaatcttaccgcaggagaactgaccaatggttataaactccggcgtgcagccatcgagctgaatatcccgctggttacaaatgctcgtttggcttctgccttcatcacggcattctgcaaacatagccctgaggatattcgcatcaagagttgggctgaatacaagtagtcgctttcact

SEQ ID NO: 61 - DNA, 794 bp, Porphyromonas gingivalis
  misc_feature (572)..(572): N = A, G, C or T
tgatacgcagggacgagctacaggtgtttactcaatctattgactcgctgagtcaattaccttcagaaacgacgcccgcagacatactttttcgtacatagtctccagtcatgctggcggtcatctgataggattcggaattcgatctaccgctcaattcatcgtgactatctggcctcaaaccgagctgctaacaacaaactagagagcagtccgacctgctcatcaaaatcgccgaaactgctggcgtgagtctgtgatcgcatgcactaccgggtcgagctaactagacctgaacactaaacaccgcgttagggtgccatcagtacatagatcgtcgtgtgcatcgcggctatttctgtgccttgccagatcggaacgcaagcttatgatcgctgctactatgtgcggagactaggcgaaacgatgcaccttagataagcttggctgctacttgaattcggctgagcgagagatgctcggtagagttgacagcctcgcagctgttggcatcggcatgcacaacctgtgctcgcagctgacctcatcatcagcacactgaatccctttgnggatctcctcttcaccatgtgcgtcttcgtcaagcggatgattactggcgtgcataagcgcccggaacctcatcatcctgagaatctgggtggacatgcgcgtattcagcggcttcctgaatgtgaagctgattcaaaccgcgggaccttcgttatcgcctgagaaaaaaacttcgcatctgattggatggattggatacctatgctcaagtggagcactaa

SEQ ID NO: 62 - DNA, 661 bp, Porphyromonas gingivalis
  misc_feature (294)..(661): N = A, G, C or T
gcttgggatataacaacatgtggctcgccgttacgtaaactcctccttaatcgcaaagagctacgcaagcttgacgaggcatttatctgtggatccgaattcgagctccgtcgacaagcttgcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 63 - DNA, 568 bp, Porphyromonas gingivalis
ctccttatacttttaccctgctcagtatcttcttccaccaagatcgaactggtgaaaatgtccatcgacgaccaatcgaactaaaaaacaatcagttgaaaggcttggcattttgaagccggttcgtatctttgtggcttaataaacacattcttaatagtgcataataaatagaaaacataataacaaaatggcgacattagagaaaatcagaggtaaagccggtttgctcatcgtagtggtgggcgtggctctttttgcctttattatcggagacttccttcgatccggatctactttcttccgtcagagccaagaagtagtcttggatatcaacggagagaaaatcaaaatctacgattaccaacagcgtctcaaagcgatggagaaacgcgccgagcaaagtggaacaaagatcaccgacgaacagcgtgcttctctgaacaatcagctcgcacagcagtatgtacaggactacgtgctcgggcagcaagctgacaagttgggtcttacggtaagtccggaagagctataggctctgattatcggtgatggtgatcaaacctcc

SEQ ID NO: 64 - DNA, 116 bp, Porphyromonas gingivalis
agagagaaacaagcttttcctcctctccctctgcttcgcctccctggtgtcgactccatggagcgaggtttcggcacagcaggttgccgccgcggatccatcccctattgtcccta

SEQ ID NO: 65 - DNA, 641 bp, Porphyromonas gingivalis
cgaagtatgacggcacaatagctcactccttcttgcttaagactcatacccggtctgtaggaagaggtcatcggcattttgccacagctggcaccccataaaccatgttaatggcagcgacttcgctctctgcctgcaagacaaccataccggtcgtatcccatggatgctcctccatgagcgtttccataacttcagactgcggagtgataggatagccgaagtagccatccacaccgttacgtattgccgagtgcgcaagggcttcattgcccttcatcagccttatttcttctgtcatattttttctctgtttttgttacaatttcactttgtaaaccgtgatacatgcatccgggcataccgttgcacaactggtgcagccgatacagctttcgggatctttcatataagagtaatgatagcctttgtcattgacttcattcgggtgtagctccagcacttttgtcgggcaagccactacacatagattgcaacctttgcaacgctgggtattaacgaccacagctcctctgatttttgccattatagttatctttttaataaggacttcgaatacctaaaagtgagtaatcttgacgcctcaaagataggtattctttccctcctgatacctatca

SEQ ID NO: 66 - DNA, 759 bp, Porphyromonas gingivalis
  misc_feature (169)..(169): N = A, G, C or T
  misc_feature (335)..(335): N = A, G, C or T
  misc_feature (343)..(343): N = A, G, C or T
  misc_feature (347)..(347): N = A, G, C or T
  misc_feature (348)..(348): N = A, G, C or T
taggatcttacaaagtgagcgcgaaaggcttcgacatcggtgcaggtatatactaccgccgcaaagaatgtccgtcggattcagctctacccatctgaccgctccggcaattccgctcaatgaacagtacatattagatcatgacaagtgcattatatattctccttgnccgtgatacaatactccgcgtccatttatatcgttatattgcatggacatccttactatactttgcacgctacatgacgggacacagactctcgatttgtgacgtgcacgactgggacatgttacatacaacaagccgctttctttctgcctcactgactgtatcngtcccacnacannagccgtgggcgtgagcttggcggatgcagttgggcaagttctatgccggctatgctttcgagtggccgacatcggtactggctaaagcctcatggggaagccacgaattgctggtcagctattctttcccattgagcaatacgaagaatagagatgcaaagtataaaagcattcgtttcctctgaaaactgccttagcgcaggattcggggagagcagcgaagcagatatctaaataatgtatgtgtagaaagaacaggtatatcgctcttgcaggcttaattctgttaggagttcacactatatcgtcgtgcggctcttccaaacgggctgttggcggtgaactgaccggtgacaagctatcttcatggaatgagccatcgccttacgggatgatacaggttccccgagg

SEQ ID NO: 67 - DNA, 614 bp, Porphyromonas gingivalis
tggcggagagcccggtagatattgattgagtgcaacagtgttacgataccttactctggccgataatcaactattaggtacttgcatgtatcgtctgcaaaattcgggatgctaactaacggtatcatctatcgcttctatacagacttggatcaagctaataaaatggatgaaaaacctttccttgaagttaatatgcttgacctacgagataatcaaatagaagaactcaaacaatttcataagtcatacttcgatgttgataagattctaagtactgctagtgaacttaagtatatgaaagagttgaaagatttgatacttgcagaaatgaatgagccctctgaacagtttgtaagaatgctcgcaaaacaagtttatgacggaattattacagcaaagatttttgaacaattcaaggatcttacacagaagtctttcaaatctgttattaatgatttgattactgctcgatttaaaacggtaatggataaaagtaaagaagtcgctgcgagtgaggagcaatcacaagagcaagatgattctaatgaacctcttgttgtaacgaccgaagcagagatggaagcatatatgattgtacaaggaattctccg

SEQ ID NO: 68 - DNA, 798 bp, Porphyromonas gingivalis
tggcgagagacgcacaggctagggatccctcagttcattcgaaagcttttcaacgcttaccgattcggtcctccagttagtgttacctaaccttcaacctgaccaagggtagatcacttggtttcgcgtctactgctcgtgactaaatgggcgcccttttaagactcgctttcgcttcggctccttgtcttgattataacaattaaccttgccacaaacagtaactcgtaggttcattatgcaaaaggcacgcagtcacaccttaatggcgctcctaccgcttgtaggcagacgggttcagggtctattgcactcctctgttcgaggttcttttcacctttccctcacggtactggttcactatcggtctctcgggagtatttagccttacgggatgggccccgccaattcacacaggatgtctcgtgtcccgcgctactcaggtgctccgtcgtctattgttcgatatgtcggatacgcagctttcatgctcttcggccatactttccagtaggttctcctatatctatcattaaacttttgtcgaagtcctattaccccgactttgccgaaacaaagccggtttgggctaatccccgttcgctcgccactactgagggaatcacttttgttttcttctcctacgggtaatgagatgtatcagttccccgagttcgctcatgaaatcattcatgtgtcaggccttggcctgacgggttgcccattcggatattgcggatcatacgaagtgcgataccgaagatttcgaagttatccgtctcttcgctcgaagctaga

SEQ ID NO: 69 - DNA, 954 bp, Porphyromonas gingivalis
cccagtcttgggatttgatttatgttgaactcaaagatattagaaagatggcaaatgttaagttattactcccatatatattgaaatggtgaaggtggtttgtccatgatcctgccgatgcaggaggggcaacaaacaaaggtgtaacaatagcgacttggaaaagagtcggctatgacaaagacggcgatggagacatcgatgttgaggatctcaagttgctaaccgatgatgacgtcctgaatcgagtcttgaaaccattttattgggatcgttggaaagctgacttaatcgagtctcaaaaggtggctaatatccttgtcgattgggtttggggttcaggcaagtatggtattgttattcctcaaaggatactaggtgtgcaggctgatggaatagtgggcaataagaccttacaggctgtcaatagtgcagatcccgatgagctgtttgagtccatcttcgatgcacgtcgcgagttcttagaggacattacagcaagaagcatacaaaagtacgaggatagcatcggacgcaaggccaccgaacgcgaattgctaaggcataccaacaaacgtttcttgagcggtcggctgacccgtcttgacagatcataggaagctctaaagatacaagcctgcaggtccgtacccatgtcaacgaatatctccatctgtcgatctcggatgggatcaagccctcatggcaatcctaagccggcgcaagggtgcgacaaaatcgataaagtggaccgaaccgagtccgcgacaactgcggcgcaccgagcacacacacacaagaaacggcgcacaaacgacgacggaccgaacgcaagacaacaaaaagctggggcccagcgaagagcgaaggaaacacagacagacaacgaacagaagaaccaaaaccaacacaaaaaaagaacaacacacacaccgcagcaagacaaaacacgga

SEQ ID NO: 70 - DNA, 921 bp, Porphyromonas gingivalis
aagaccaccagcttatgatggtatagcttgcaggccgaagcggtttcgacttccatatcagttccatctcccattccggcgcgacgcatcgtgaagttgtacttcttgccgtgcttcgaatgtgaaatcgtcataacgtgcaggctggttgcctccatctcctgcgatccacatctttccggatgcaggttccgggttcgtaatgcaatagtcgtaaacaccaccggggattacaacttcaccctgtcctgtaacgataatattctgtgtagtaacaacaggatcggcattggccgggatcaaatactcgaagttcgcactgtaaagatcggaagaagctgttccggtaaagagaggaccggttgccggaatgacacttccgaatgtattgtgatcggcatccaacaagaactggtaacccgtattgtctccccatacgttgtctgctgcgagcacaaccttggcttcgttggcacgtacatcgtttgcaggttcgatcgtaacgaaaagaccgtctccgatccgttttacttcacgagaaccttctgtcttctttgcgctcggggcttcccacttgagaaccacgtcgccgacatccggttgtgccttcaggttctttacaggattgaactgtgtcgaataaacagttacgtttacacatttcttcggagatacgccggctgtgtacttcacttccacgcaataatcatgatcgcccgtaactacgccgacttcatcgaaggtcgtaacggtcaaaccttccttgatctcggtaccataacgaaaaccgggtaagtataccagcagcgagggagagacccaagggaacggataaccacaaaagactccacacgaaaaaccgagaccacaaaaacacaaaactaggacgaaaacaacacaacgaagcggaaacacaaggaa

SEQ ID NO: 71 - DNA, 899 bp, Porphyromonas gingivalis
aggcttgagatctcttgctattcttagtcgttttggcagatgatctccacgagtacatccgcacgataacgcttttgggatatccttgtgtctatgagcggatcattgaacgcatccacgtgtcccgaagctttccagatcgaaggatgcatgaagatggcagagtcgatgcccaccacattatcatgcagcagggtcatactttcccaccagtagcgtttgatattgttcttcagttcagaaccgtattgtgcatagtcgtacacagctgccagaccgtcgtatatctcggacgaaggaaagacgaagccgtattctttgcagtgtgagactatttttttgaagagatcttcctgttgtgccatgctatcttgatgtgtgaatcttattgtattcctacattttacctcgcgaaaataatcctttttcttcaatagtctcctaaacgatttgaggtacacatcccacaaacaaatgcaacactaagataaatttagcaagaagcactcgaaaggagttctaaagtttagttttttctgggtctatggttcagttaggtcgtatcgttgtacgacctgacgaaaaaggccttcctatccgaaaaatcatcacactatcattttctccttgaattcggtctcataccggggatatctggaatgattccaattcctctcgtcgtgaaactttggcacataaaacatgatgcatgcggactgaatacccgggtcgattcagctccgccgaaggtgcggcgatacagacacacacacacgacacgcggaacaacgaagatcatcgcgagggacgcaaaaaaaatacctggggccaaagacaggaagaaagaaaacaagagaacaaagaacccggtgaacaacaaacaaggaaaaatacaagaa

SEQ ID NO: 72 - DNA, 791 bp, Porphyromonas gingivalis
gattgatgtgcagttgcctctgcattacagtggattggtgctgtgcatcaagatggtcaatggagactcgatctctctaattggtgtcttggtcgctatcaaggtaagggggaatactctttgctaagtctactcaagcgaggtaaagaaacgatagaggagattattcgccctgtcgatccgcactacagctgtattgctctacgggcaggtggatataatgctcagccgtccgaggagattgtccgagcgatgcgacaagtcggtctcaaagtagatagctctatttacccaggaggctttgagacgggtgcgctatccaattacgattacagctccgtagctcccgatttaggacattggtatgtggaggatcggctcgaatactcggctcatggagcaacagacattctggagttacccattgtcgctttcccaattcgtcgcttgcagaagtatctgtcattggatcggattaaggcactcttccaaaatcgtaagtccgcggcagatacttattccgccaaaacggccaacaaaggggggatttggggcaagataagttactttgtagagcttgaatggcaaacatgggatttctgcctattttccaaaaatctgcatcgtcgattcttgaaacgtgttgagagccaacgggggcgcaaggagtttgttctggttggacacccgaagagcttcgtctccggggagagtttaattatcttatcgggcaacttaaaagcagctatcagttcttgagcctgacagagttgatctgtggatccgaattc

SEQ ID NO: 73 - DNA, 138 bp, Porphyromonas gingivalis
tgccacaagtcttttaatgggcgaaaaggcttcggactcgcgggcacgatcggctactcaggttcttttacgaagagttgtcatcgatggcaaaagccacatcgcggtgcaaatatctaggttgtagttttgctatct

SEQ ID NO: 74 - DNA, 806 bp, Porphyromonas gingivalis
aacgacgacgacaaggccatgggatactgcgcaggagttcacggatattgttgccgtcagccagatgacacccggccccataggcatcaatagtgccacatacataggctataccgtgaccggcaacgtatggggctccgtcttggctacggtagccgtcagcctgccatctttcgttttggtattgattatttcggccttttttgcacgattcagacgcaacacttatgtcgatgccgcttttacagtggtacgtcctgcttctgttggcctgatcgcggctgcagcactattgctcacattccagccggacttcatttcagccttgttcgccaccggctcggcaagcctcgatcaggtagtcgtacgagagaacttcaccgacctttggagcatcctcctgttcctgctatccttccttgtcaccgtcaagaagtggctccatcccatcctcacgatactgcttgccggtctcgccggcctgctgatatacggcttctgaaaacgagctatgccataaatcgaattatgacacaacccattcggccggcttaggatttccaagaagggctttatcccaaccgagatcgacagatggagatattcgttgacagggtacgaacctgcaggcttttatctttagagcttcctaatatcttcaagacggttcagccaacctctcaagaaacgtttgttggtatgccttagcaattcgcgttcggtggccttgcgtccgatgctatcctcgtacttttttatgcttcttgctgtaatgtcctctaagaactcgcgacgtgcatcgaaga

SEQ ID NO: 75 - DNA, 683 bp, Porphyromonas gingivalis
cgacaggtctatgggatgaagagcaaaactgctcgacatatcatcaaataagctatttctcagatgaaacgaatacttccaatagtcgcattcctttctctcttccttgcccttgctttgcctgcgaaagcgcaacgagctatggggaagacggccgaccgttcgctaatggcttcgggacattgggtcaagatacgtgtcgatgcaagtggagtgtatcgccttacggacgaacagctccgtgccaatggcttctccgatccgtccaaggtaggtgtgttcggttatggtggaggggtgcttcccgaagatctgagccggatcacgacagacgatttgcctccggtaccggtactccgtcagggcaatgcgctgtatttctatgccgtgggcccggtgacatggttctacaatccggccaaaaccaccatggagcatacggtgaatacatacagtacgcatggctactacttcctgtcggatgctgccggagcacctttgcagatgtcccaatatacgggtggaggtgcgtcggccgaggctttgatcgactactacgatgagctgatgctccatgaacaggaattgtattcgcccaaagaatcgggacgagatctgtatggcgagtctttcagtgcagtcaatacgcgtacggtcaagtaccctttgaggggcaacaaacc

SEQ ID NO: 76 - DNA, 502 bp, Porphyromonas gingivalis
gggtaaaatgaatacgcttgtattacgagtcttgctgggcaatgacaaacgatccctcccgtgtggaattgtagctacgccgttcctgttcgaatccatgctcttttctgtttgcacgcgtggctatgcacgaatattgatcgattcgagggacatcgacgtgaaggaaggcgagctattggtagatcatgcctcgcactacgatacaattgattgaagtcctcttgctttcgtgcctttcatttatgtcttggacaaggagattcttgctttactcggagatcaggatcagctgttttatctctatcatcaataagctacacagctctgaaccgttccgtccggaatgcttggagaaagattttctgacggcaatgttggatctcatcctgaatgccctgataaagggggggcgtcatcaggaagagattgttgtctatctgatcagctctctctttctctttcttgacgatatgattgccgacgaggtcgataaggactg

SEQ ID NO: 77 - DNA, 769 bp, Porphyromonas gingivalis
acagcttgggatctgctgacgatctgtatataaacctatttcaatttatatatagatcgttttcaatttatatataaatcgttttcaataaatatatatatcgtaaacgattgtatataaaacgcaggccccaaaaggccttttcggggcatgataaaaagaagacacccgtcaggttcgtgacagaacctggcgggtgtcgtataggttaggagcgaaagagggttactccttatttgttaattgaaaaaatgtttatttttttatttcaatgcctatgaaggcggcaaaatctccaaattcaagtacacgtggacttggcttgtcgaaggggttcggcttcccatcagcttcgtatttgttacctgttttcaagtgtacaagcattaggcgtagctcaggggcctccaattctttgtttacccgaatataaccggtaaatccaacgggggtttcaagcaattggccattaatgacatctgagtagtaataggagatcccttttggaacttctgtttcgttgctcatcaggttgaagaaaaactgatgtatctcgatctgatcaggctgaaagaatcgttggtttagtcggttgttctccttgtcgaaaagataaatctccattttataccatattcccttcttaagctttggtttctggctaccgggtagggctgcaaaagagccaaaagcattggagaccatgtggtgaatacttacggtatctttggagaagaatgctgttggacttacgtctatactggtatct

SEQ ID NO: 78 - DNA, 52 bp, Porphyromonas gingivalis
aatacgagcagcagaatatggcttatcgaagcaatcgtgtgccgatgaaaga

SEQ ID NO: 79 - DNA, 957 bp, Porphyromonas gingivalis
aaccccatgctttatgctagaccactgactacaccctcaacgacgtgtactgacgacgacgacacgtacgactatttacggacgacgcgacttttacacaaaagagggttgatatgtctatatcggtactatgtccggcggatgggtctgttatgacagatcagggaacagaatactggagcaattacctgaaattattgtttactcttcaaaagacaccccggtacgaacgtactaactacgggaccggacaaacgaccttcgtcaactgccggacctgggtacttgcatccacctactactggtttactagaggtggataccacaacgtggacatgacagcctggcatatgacaaaaacacgacggtttgacgataccggtttcagacaacacactggacacaaaccccgggtgctgctcactggcgaaacagtccaaacacataccggtccgaacagctcgaagaacagcacgggaccttgactaacggccggaggagccttactcgttgcagactacttgccttgtcaggagaaccctaaacgccttctcatgcgactaaatgcttgttactgtacggagcctccaccaccggagtcggcactctcgtcgcgggaccttggtaaatccttgactatgggaccactgggtgtgaactatcatgatcaagagacaggcacaacaacagagctgacatcatagatgcaacaatcagacaacaagcaatgaccaaaggaaacaaaaaacaggacaagacaaacatcagcccaccaaacaccaataagaagatagcaatgagacaacccgtaaaacattaagatagggacacacgagcaagacaagaacagaacaaccgaaaaaaggaaacaacgacagcacaaaaacaagacaaaaagacacacaggacaacacaaaccaaaacgaaaagaaaggcaaaccacacaccgaagacaaa

SEQ ID NO: 80 - DNA, 934 bp, Porphyromonas gingivalis
gacgacgacagctagggattgatttatgtgaactcaaagaattgagaaagatggcaatgttaagttattactcccatatatattgaaatgggaaggtggtttgtccatgatcctgccgatgcaggaggggcaacaaacaaaggtgtaacaatagcgacttggaaaagagtcggctatgacaaagacggcgatggagacatcgatgttgaggatctcaagttgctaaccgatgatgacgtcctgaatcgagtcttgaaaccattttattgggatcgttggaaagctgacttaatcgagtctcaaaaggtggctaatatccttgtcgattgggtttggggttcaggcaagtatggtattgttattcctcaaaggatactaggtgtgcaggctgatggaatagtgggcaataagaccttacaggctgtcaatagtgcagatcccgatgagctgtttgagtccatcttcgatgcacgtcgcgagttcttagaggacattacagcaagaagcataaaaaagtacgaggatagcatcggacgcaaggccaccgaacgcgaattgctaaggcataccaacaaacgtttcttgagaggttggctgaaccgtcttgaagatattaggaagctctaacagatcaaagcctgcaggttcgtaccctgtcaacgaatatctccatctgtcgatctcggttgggataaagcccttcttggcaatcctaagccgggcgaatgggtagtgcacaatacgatatctgaggatcagattcgagcacggcgaaaagctggggccgatcgagaccacacacaccaagagaccggtggtacaaccgaaggaagaatgtgggcccgtgacaaatatcccagggacaaaggaaaggtaagaaaggacccggggaggaacgaagacaccagaggaccaagaaaacacacaaaacaaa

SEQ ID NO: 81 - DNA, 812 bp, Porphyromonas gingivalis
agcggataacaattcccctctagaaataattttgtttaactttaagaaggagatatacatatgcaccatcatcatcatcattcttctggtctggtgccacgcggttctggtatgaaagaaaccgctgctgctaaattcgaacgccagcacatggacagcccagatctgggtaccgacgacgacgacaaggccatgggatgtcgcccgatgcgccgagcgaaccgcgatcgtaaacgatggggagtacgtcgttattgagcatgtccaggatacgctgcacggtgcatagctgtacgccactgtgtcccaactggagggcatgagctttgagcagaagcatcaggcgcacgatgtcctcatgaacgggcgtgccgcagctacaggcatgactcttgacgaggttctcctgtaaggcggtaagctgatccggtgtaattgtcctgttgcagagagagccgaagccggtggtcacgccgtatatgggtttgtccgactgcttcactttctcgtccagatagtggcggcagtgctcgatacgtcttacggcatcggctgagagttccagcttgaagcgactatccagatattcgcgaagcagatccagagagagcggttcggaaccaacttgaaaagaggtacgtgccatcgttattcgcatgcttttttggtgatagccaatatctcggcctcgcgacgtatagcatcggcttcgatcgcattggcttcttccgtatgcgatctgtggatccgaattcgagctccgtcgacaagcttgcggccgcactcgagcaccaccaccaccaccactgaga

SEQ ID NO: 82 - DNA, 1263 bp, Porphyromonas gingivalis
  misc_feature (502)..(502): N = A, G, C or T
  misc_feature (551)..(551): N = A, G, C or T
  misc_feature (613)..(613): N = A, G, C or T
ggagacccccggcctattggaatatccagtcgaagattgaactccaatccgtgtttacaaccagccgtgctatgacgtcagaatcgtatcgtaacagagctacaatgagggctctcctatcgtacatgcgaagggtcgatccctcaagtgatattatgccgcctcggtattacgagtagcagtaactgcgtacataagcaagaatctgacactcattatggctaacgagacagacgtggaattgttcacccgaatacggcgatcactaggcatgcacatcttcttatattatctcagtattactcatcgagaatatccaatctaagaccgaatctaaccaatagcagatgtaaccaactgagtcaatcgtataataacatgggtctgatatgtgtcgctccacgaagcttgagcaattcgacaagacatccgtctcatcgcctcgagccttgagacgattcgcaggtacacagacaggaaattcactggaccactacttcgnttgtccgtggcatgtgatagcgctacccgaactagacttagacttgcgntcatactcgtgcgatatccacacgtacactatacttctcgaaagtcgacgttgtgcgtctangccagattctgctattccctatgacgacaccggcgcaatgcgattgagtaccagaggattccttacgcagggaaggtggggtttccttctattacttcctatcaattctattctatgtaccttgaatacacgtcctatgaagtttactacgtttatgcgtgttgactagtgcacgcgcacatttgcgagtttgcgcatgtgccacaagacatgacattctagtcaccaggtactctcgtacctgggcttgaggcacaagtttaaaggtccaacaaggcacacacaagttatacatacactacgggtccctgtgtgcactgaatcctagggcggaataaagccagtgcttgagagcctgacctccccagtgagtttatgcccgtggtggttacgagcaattccgagcatccttcacttgttggaattgaatacggccttgcgagtatagctcttaatcgataacggtttcgaatacacatgattgctggactggaatttaccaacacgtcatcggacattctccttcgtcacacgaatattgccgatagaatcccacatattgggtaccaggcagacacaacaagcgtacaatccttttcccagaaacgcttggtccactggatagtgggggtttacttggcggaaaggga

SEQ ID NO: 83 - DNA, 880 bp, Porphyromonas gingivalis
tgtgagcggataacaattcccctctagaaataattttgtttaactttaagaaggagatatacatatgcaccatcatcatcatcattcttctggtctggtgccacgcggttctggtatgaaagaaaccgctgctgctaaattcgaacgccagcacatggacagcccagatctgggtaccgacgacgacgacaaggccatgggatcgcatcatctcagagaatacttcaagcaccggcgaatggctcaagatggctcaaaaggcatataaaaacatctatgcttatgaatggcaaggcgataacctgctccttgctcgtgaggcactactaatcacctttatcgagtattatgaggagaagttcggtaagcgtcccctcgacaaatccattgagtatattgcctatattatctcttggaatgtctggcagatggatgggctcaagggagtcgtccctaatagttgcacacatggtgtgtccgtcctcccggacgacctctttgagtctatggaggagctgatactctgccccggctgccaaaacgaaagcatcaaaaagcataacggcacgtactgcctcattcgagactggggctgtaaagaccccaagacgggagagaataatcgcaaaattcgattcgttgatctgataaagaataatatataatctctcactatggcgacctttgaatcttctctcaaaccccgccttatctatgtgtttgctattgcagatgcccggcacgagggtagcctcaaaataggagaaaccacccttaacgatgatgtgggttcggcttccaccgaaccgaatagtgaggtgctcaacaaagcagccaaagctcgtatcgaccagtataccaaaactgcaggtatcggtta

SEQ ID NO: 84 - DNA, 703 bp, Porphyromonas gingivalis
cgtcgagagaccacagtcttgggatatatattgcatactctaggtctaaagttcttggacggaaccacccaaatcctccgaacgtgctgtcccgacgaagatcgtacttgtgcgttccgtacataataccataggctactcgtgcagtgatagatccctccttactttgatacgacaacttggtagtcctctcctgtgcgatcataggatgctctcatgtgcgaccagcataatcctctcatcggacaacatcagtgtctctctcgtgtgatagcatatgatcctctcaataggtcgtaccctacatatatactctcgtgtgaatccacactatgagtctactggacaactcgactatcaggacgtatcggtgccataattctatacatggcccgaatgcggtgtttcggctgtcatgctcacgaagattgaggctgcttgcgtctacatacaccttccgatagtactgctcgtgcagggaccttcataagatatacagtctaatgcgaattacgccttgccccggtggataatgaacatgcatgctgccgaaactatggagacggaacccgcacgggtaatagtcgaaccggtagcagatacggagactgcgagtcactacatggaaccacgccaataccaacagacgcgtgccagcatccgcataccacacgagcagccaaaaaaacaacctaatcgccag

SEQ ID NO: 85 - DNA, 741 bp, Porphyromonas gingivalis
atgccttgggatacatggaagaaacggatgagagcctcgattgtcctcagagcagtagccacatcctgcaactctcgctcttccagataggtaccggcaggtcggatacggtttagtgcttctcgcacatcggccagacggagatcgggaaacaagtcttcttctctcaggataatctgcatttcttccgtctcggcaagcaagcggctgacttcgttatgccttgcaagagcatgcatctgtattacccgatcgctgcccatcggactatggcaatggccgatgagaaggcgacgaatctcatcgaaacccactttctcctcgaagttgtgggggtaagtctccatccgaatcatagcggtctgtcagcgaaaagccctgagcaagtcattgccattggcatagagaacgagaagaatcagaatagccatcccgatcaattgcgcacggataaggacttcctgaccgactttcctgcgggtaatgatttcaataagaagaaagagaatatgtcctccatccaatgccggtatgggcagaatgttcatgacggccagcatgatggagagaagtgccgtcatagcccagaattgaggccagttccaagaggccgggaaaaggctgcccaatgtcccgaagacacctatctgtcctgacccttctttggtgaagacgtacttcatgtcgcttacgtagctgcgcatggtgcccataccttgtgctattccgcgcggtatggct

SEQ ID NO: 86 - DNA, 691 bp, Porphyromonas gingivalis
ttgggatttagtggttcgcatatcgaccgtcatgtgctactccaaactctcttttgcgttagagcaaaatgcaaagcacgctctttctctgcctgcgctaccaaaagaggatggttttatcgaagaattgagcgaagccatagaaaagcttggagagaacctattcgacagcaatgcgcctgccgtagatgttgccgaactcatattccaacgtaaactcagaaatcaagctaataagaaactaaaacgcagaagattatgaacgaccaaatcaacgtcctcctcgaagtactcgaagaaatcaagcaacagaacagagaactcaaagcgagtatctccaatttaccacaaccaacagagtcgcaaggagaagtcgagaataggaaaaatctcgcaggaatcgccaagattttagaggagcaacaggagtttcatcgtcgattcagagaggaactttgtcaagtaattgctaaacttggagagcgcatctacgaaatgaagtcaggcattaccgaggtacggataagtcaagacgaagcgaccgaaaaactcttgacagaactccaaactaaacaaaccacacccgaaataaagctttccaaatactaccttttcgatgtcaaacgctgggcagaatggctcatatggggtgtgatgatcgctgtccttgcctgcgtcattggttgggcga

SEQ ID NO: 87 - DNA, 276 bp, Porphyromonas gingivalis
gcctcgactcgaatatgaactaatcgcttataatacttatctataccctcgaatgggttttgctcatcgtcttgcagagttctggcattggagagcgccaaccccggcaacccctccttggggaatactggcctccgtttataattccgcatggatcgttgatgcctatatcatagccctgtactatagtcaattattatctgatagccccattcatgatcaagaggcacctctttcgtccctatatcgtgctgtcactggccttgggcggaatag

SEQ ID NO: 88 - DNA, 647 bp, Porphyromonas gingivalis
  misc_feature (1)..(1): N = A, G, C or T
ngacgagacgagccatgccttgggatagatagaaagcgattcgtacagattcatacccacgaacaggagtgagtttcctacagccgtagcacacagccacaagccctgcataataccttggagatggggaggtgccaccttagaaacgaagctgatacccatcgggctgataaagagttcggcaatcgtcagaatcatgtaggtcaataccatcaaccaaggagaaactttcgtaaactctacccctgcattacgctcttcgaaagtaggcagtcccattgaaccgatagccatcacgacgaaagcaagtgcagcgataaacataccgatcacaattttcttaggggtggaaggctccatattacgtttcttcagaaaaccgaagatgaagagcagaagtggcgtaagagttactacgaagaacgggtcgattgactggaacatttcagctcccactattgacgtgaaaccaagatcgagttttacactacttaggtcaatataatccttagcaaactgagtcagcgatactccgtatcggtggaaagacatccagaagaaaataacgacaccgaaaactgcgcaaagagcaataatgcgtcggcggatctcatcggctgccatcttgatttcttgctttcgatctt

SEQ ID NO: 89 - DNA, 2271 bp, Porphyromonas gingivalis; identical to SEQ ID NO: 57
  misc_feature (77)..(77): N = A, G, C or T

SEQ ID NO: 90 - DNA, 756 bp, Porphyromonas gingivalis
tgagcggataacaattcccctctagaaataattttgtttaactttaagaaggagatatacatatgcaccatcatcatcatcattcttctggtctggtgccacgcggttctggtatgaaagaaaccgctgctgctaaattcgaacgccagcacatggacagcccagatctgggtaccgacgacgacgacaaggccatgggatccggcgaaagagggaaagaatatcgattggttggggagatttgatcatgagacaaaaataagcggtctgtaccaattattttagcgaaacgatattacgatccatcctaaagttccggccaaatcagattgcacgggttggtttatgcgcaagatttttctcttttgtccttcttgaaaacgtgacgtgcaccgaaaaagttgatgctcggaatcggtcaaatgtttcgacataattaacatcagcacgatagtccatttagagccggtgccatagagtggagcagtttttgtagttaatacagtgtacatttgtgtcgataaaaggcgaacaacccttttcgaccgcatcaacatgctgataatgaataaaataaaaaagtgaaagcaatataatgaacaagcaaaaaaacaatcgcgaacgaacgcctcagcccgaacaggataccgaaagagacgaacaactgacaaacagtcacgaaaatgatatagatagtgcccccgcagccgaagagaacgacaaggtggcagacccggtggagcagctcacggctca

SEQ ID NO: 91 - DNA, 737 bp, Porphyromonas gingivalis
atgccagcttatcgtaaagggacctcggttgcaatcggatcattcgggtatagttgcccgtgttcccctgggggtgatcactttgaaaaatcattgccagattcataaagggtggtgcgcacaagagtgagactcttaggaaggagtcccgttaagggggcaactgatcccgcgttattgtgctgttgctgagagagacgaagacggtggtcacgccgcatatatgtttgtccgactgcttcactttctcgtccagatagtggcggcggtgctcgatacgtcttacggcatcggctgagagttccagcttgaagcgactatccagatattcgcgaagcagatccagagagagcggttcggaaccaacttgaaaagaggtacgtgccatcgttattcgcatgcttttttggtgatagccaatatctcggcctcgcgacgtatagcatcggcttcgatcgcattggcttcttccgtatgcgatctgtggatccgaattcgagctccgtcgacaagcttgcggccgcactcgagcaccaccaccaccaccactgagatccggctgctaacaaagcccgaaaggaagctgagttggctgctggcaccgcttgagcataactagcataaacccttgggggctctaaacgggtcttgaggggttttttgctgacagaaggaccatatccgcttggcgattggacgcgcccgtaccgggcaaaaaccgcgggttggggtccgct

SEQ ID NO: 92 - DNA, 770 bp, Porphyromonas gingivalis
tggcgagagacccagcttatgatatagtcgctattctatccttagaggttattagacaaaactactcaaaataataacgtcatgtctcaagaaaatcgtacttgtggttcgtaaataatttcataggccaatggaggattttttccctcctcacatcgtttcgccgacttggtggttttttctctactttagcgggcggaaaaattattcgcaagcatatttttcttctccccaaactctttgcttttttcgcaaatgccaaggatcgatcgaaaaatctcattctaaaatcaccaataattatcaccaatacaagtatgaaaagaagcagacttttaggccgcatcgtagtactatctctatgcgttgccacaattccggcttcggctgtcagccaaccgcagatgacgcccttgcagtcgacacacacctccgatcgttcgttcggcaggggagctcagcagatagctgacgaatggagtgccgccatgccccaaaccacatggagcagccatgctgatgtcagttggtacacggcagacggcacggaattcactctcaccactgcggagcagtttgcaggcttggccaagctcgtcaacagcggaaagtccatgaagggtgtgaccatcaagctgggtaatgacgtggacttctcggctaatcgcttcgatgaggtgatcggccaggataatgacaaccccttttccggcactttcgatggaggcaaacatacaataacgggcgtgatgatcagggatcccgtctgg

SEQ ID NO: 93 - DNA, 745 bp, Porphyromonas gingivalis
  misc_feature (29)..(29): N = A, G, C or T
tgggatatagtcgctattctatttttaangttctagacaaaactactcaaaataataacgtcatgtctcaagaaaatcgtacttgtggttcgtaaataatttcataggccaatggaggattttttccctcctcacatcgtttcgccgacttggtggttttttctctactttagcgggcggaaaaattattcgcaagcatatttttcttctccccaaactctttgcttttttcgcaaatgccaaggatcgatcgaaaaatctcattctaaaatcaccaataattatcaccaatacaagtatgacaagaagcagacttttaggccgcatcgtagtactatctctatgcgttgccacaattccggcttcggctgtcagccaaccgcagatgacgcccttgcagtcgacacacacctccgatcgttcgttcggcaggggagctcagcagatagctgacgaatggagtgccgccatgccccaaaccacatggagcagccatgctgatgtcagttggtacacggcagacggcacggaattcactctcaccactgcggagcagtttgcaggcttggccaagctcgtcaacagcggaaagtccatgaagggtgtgaccatcaagctgggtaatgacgtggacttctcggctaatcgcttcgatgaggtgatcggcaaggataatgacaaccccttttccggcactttcgatggaggcaaccatacaataacgggcgtgatgatcagcgatccc

SEQ ID NO: 94 - DNA, 713 bp, Porphyromonas gingivalis
  misc_feature (380)..(713): N = A, G, C or T
atcttggggatacgccggagaagattcttcgaaaaggccgggatcatcaagtccggagtccccgttgtggtcggccgagccgagggaggtgtgcgccatgcctttcagcacaaagccgatgaggaaagaacggatattgtctttgctcaagaatcgggcgtaatcatttcctctgtggatccgaattcgagctccgtcgacaagcttgcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 95 - DNA, 876 bp, Porphyromonas gingivalis
ggacgccatgcttaggatcgaaaacttggcagccggcgaagcttatcaggaagaatatcgcaagcagccgggcgttaaggctaccgaaagcggtttgtgtctcgtgtcttgaaggaaggggaaggacctcgcccgacggttcaggatacggtcgttgtacattatgtgggcaagaacattgaagggaaagaattcgacagctcttattctcgctaacgcagccggcaaagttcagcctcctagcaagtgcattccgggcatggacttgaggtgtgttttgtcttgatgccaaaagggttgccaagtacgcaattctgttatcccagacctgaactgtggcatatgtgcgcaacgtagccatggtgctgcaacttctcaagcacgaactctcacgcttttcttccgaagtagaactactcgcaaatcaagccttatcgtagagaagccggcaaagcctatcccggcaaaacctactccaaataagaaaaactaacgataaaaaccatcacgggaaactccaaatgacacaaacacattgcaaatatcgcctcagccctcttggcttaaggcgccgtaggatgtaagcacaaaagcagacaccatcacgctgtcagtgcaacaggatcagcatcgacatgcaccccgggatatccgcacggacaggaaaagccacacaaaacaaatgtccgatgccaggccaccagacgcacggacacaacaggacggacaaaatggaacagaccacagacaaccaacacagagacccaccgcacaaacacccccaacgacaaaaccatgaaaaaagatcagacacaaccacacaaaaaagacaacaacccgaaaacaaacagacagaaaataacaaacacccacacc

SEQ ID NO: 96 - DNA, 802 bp, Porphyromonas gingivalis
gataacaattcccctctagaaataattttgtttaactttaagaaggagatatacatatgcaccatcatcatcatcattcttctggtctggtgccacgcggttctggtatgaaagaaaccgctgctgctaaattcgaacgccagcacatggacagcccagatctgggtaccgacgacgacgacaaggccatgggatcgcgctttacgataggttattccacacgtgagatcattctgttggagttttcttccacggttatgtgtctcattctggccggtaaggtggggtcgagtattgcctccgaattgggaaccatgcgtgtgactgagcagatcgatgctatggaggtgatgggtgtgaactcggccaattatctgatcctgcctaaaatcatcggattcatgctgttcgttccggttctgagtataatcagcatgtccacgggtattgtcggtggttatctggcctgttcgttggtgccgaatttgcctcggagcgactttgagtacggtttgcagcttttcttttccccttataatgtgttttactccattatcaagtcggtggcctatgctttcatcatatcgagcgtggccggttactacggctatacggtgaaaggtggggcattgcaggtggggaaagcaagtaccaacgctgtggttcagtgcagtatattggtgcttgtggcggatttactcctcacgaatttattgcttgcgtaaatgttatactaacgtattatgatcgaagtcagagaagtcagtaagcagtttgaagacaagaaagtactcaacaatat

SEQ ID NO: 97 - DNA, 652 bp, Porphyromonas gingivalis
cttttgagtattagacaaaactactcaaaataataacgtcatgtctcaagaaaatcgtacttgtggttcgtaaataatttcataggccaatggaggattttttccctcctcacatcgtttcgccgacttggtggttttttctctactttagcgggcggaaaaattattcgcaagcatatttttcttctccccaaactctttgcttttttcgcaaatgccaaggatcgatcgaaaaatctcattctaaaatcaccaataattatcaccaatacaagtatgaaaagaagcagacttttaggccgcatcgtagtactatctctatgcgttgccacaattccggcttcggctgtcagccaaccgcagatgacgcccttgcagtcgacacacacctccgatcgttcgttcggcaggggagctcagcagatagctgacgaatggagtgccgccatgccccaaaccacatggagcagccatgctgatgtcagttggtacacggcagacggcacggaattcactctcaccactgcggagcagtttgcaggcttggccaagctcgtcaacagcggaaagtccatgaagggtgtgaccatcaagctgggtaatgacgtggacttctcggctaatcgcttcgatgaggtgatcggcaacgata

SEQ ID NO: 98 - DNA, 61 bp, Porphyromonas gingivalis
gatactgccagtcaattctgtagtcggcaaggcttccggaaaggaatggaaaaacccagat

SEQ ID NO: 99 - DNA, 617 bp, Porphyromonas gingivalis
  misc_feature (561)..(617): N = A, G, C or T
  misc_feature (6)..(6): N = A, G, C or T
acctgnccgaacggtacgccatatcatcggttttcgataagaccatggcggaggcgttggaaaaccaacgataatctatgttagaacaaaacaaatatggatattcagattcaagggcagcttattcagatactgccactcaattcgggagtcggcaaggcttccggaaaggaatggaaaaaacaagagtacatactggaaacgctcgatcaataccctcgcaaaatacacttcagcgtgtggggagatcgtattgatccttcctatcaagtaggcgatcaggttacggtctgggtcgatattgaaagccgtgagttcaacggccgttggtacaccgatgtgaaggcttggatctgtggatccgaattcgagctccgtcgacaagcttgcggccgcactcgagcaccaccagcagcaccactgagatccggctgctaacaaagcccgaaaggaagctgagttggctgctgacaccgctgagcaataactagcataaccccttggggcctctaaacgggtcttgaggggtaatttgctgaaaggaggaactatatccggatnnnnnnnnnnnnnnnnnnnnnnnnnnnnnnnnnnnnnnnnnnnnnnnnnnnnnnnnn

SEQ ID NO: 100 - DNA, 960 bp, Porphyromonas gingivalis
  misc_feature (47)..(47): N = A, G, C or T
  misc_feature (59)..(59): N = A, G, C or T
  misc_feature (416)..(416): N = A, G, C or T
aaagagcatggctgtgatgacccctgttcattatctacagagaaganccctgtatttantatagctgatagccatgaggctaaatagacttacgtgccgggatgtacttgatgctctggcttgactcgacagcatgccagagctgaaaccaacactatgtgatgctagctggagctttgcatactgccatacacgcgaaacaaatgggctagaacgccgaccagctactcataacacgatgcatgcgacagcacactgctgagcccgagagacacaaaaaccaatcctagacatgagacatcgcagacagacaactactagaacagacaccacctcatcacacatggaaacacttgacttacctaagatcaatcacaacgcaatacacacattattaacagacacaacacacacangactcactgaacatacacacagcaaacaggtcatcatccaatgataatgagggaccgtagacatagcatcaactgacagacatgcacatgactgtgtaagaaacagacgacagcacccgacaggcaacaacaaagcacagcatgctaacacacacaataccaagacataccctgcagacactctcgcatacaatcaaccaacgcaggctgaacaagccatacacctgactagtgcacgagtgacaacaactacacaaccgcacacactcaacatccaccagcgtcacaccgagccactgtgagtcgcatcatgaactacgccactgcacacacacaaactggtatcgacagcacacgatgcagcacaaaagacggtcgcgtacacacaacaacacacgaagtcacctacactacacagaacaataccaacatgaacaacccaaccacatcacaactagcaacacaagagactacaatcacaaaccacaccaacgaccaccgccatcataccaacttctacacaaacgcgccaacgccaacacca

SEQ ID NO: 101 - DNA, 767 bp, Porphyromonas gingivalis
cggataacaattcccctctagaaataattttgtttaactttaagaaggagatatacatatgcaccatcatcatcatcattcttctggtctggtgccacgcggttctggtatgaaagaaaccgctgctgctaaattcgaacgccagcacatggacagcccagatctgggtaccgacgacgacgacaaggccatgggatgcagccaagatagagagcgagatcgccgaactggagacatacgaagagcggcaaatgttcctcgaagagatcggtctgaaagaatccggcgtgagccgtctgatcaaagccgcttatcacttgctgaatcttcaaacctactttacggccgggagcgatgaggtaagggcttggacattcctccgcggaagcaaagcacctcagtgtgccggtatcatccacaccgattttgaaaaagggtttatccgtgccgaggtcatcaagtacaatgactttgtcagtcttggcagcgaacaagccgtgaaagaagccggtaagatgagtgttgagggaaaagaatatgttgtgcaggatggatctgtggatccgaattcgagctccgtcgacaagcttgcggccgcactcgagcaccaccaccaccaccactgagatccggctgctaacaaagcccgaaaggaagctgagttggctgctgccaccgctgagcaataactagcataaccccttggggcctctaaacgggctatatccggattggcgaatgggacgcgccctgtagcggcgcattaa

SEQ ID NO: 102 - DNA, 694 bp, Porphyromonas gingivalis
cagaccccagctaatggatgcagcaagatagaccgcgagatgttcgactggagacatacgaagagcggcaaatgttcctcgaagcagatcggtcttaaagaatccggcgtgagccgtctgatcaaagccgcttatcacttgctgaatcttcaaacctactttacggccgggagcgatgaggtaagggcttggacattcctccgcggaagcaaagcacctcagtgtgccggtatcatccacaccgattttgaaaaagggtttatccgtgccgaggtcatcaagtacaatgactttgtcagtcttggcagcgaacaagccgtgaaagaagccggtaagatgagtgttgagggaaaagaatatgttgtgcaggatggatctgtggatccgaattcgagctccgtcgacaagcttgcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgcttt

SEQ ID NO: 103 - DNA, 761 bp, Porphyromonas gingivalis
ctagggatatagtcgctatctattttaagtcttagacaaaactactcaaaataataacgtcatgtctcaagaaaatcgtacttgtggttcgtaaataatttcataggccaatggaggattttttccctcctcacatcgtttcgccgacttggtggttttttctctactttagcgggcggaaaaattattcgcaagcatatttttcttctccccaaactctttgcttttttcgcaaatgccaaggatcgatcgaaaaatctcattctaaaatcaccaataattatcaccaatacaagtatgaaaagaagcagacttttaggccgcatcgtagtactatctctatgcgttgccacaattccggcttcggctgtcagccaaccgcagatgacgcccttgcagtcgacacacacctccgatcgttcgttcggcaggggagctcagcagatagctgacgaatggagtgccgccatgccccaaaccacatggagcagccatgctgatgtcagttggtacacggcagacggcacggaattcactctcaccactgcggagcagtttgcaggcttggccaagctcgtcaacagcggaaagtccatgaagggtgtgaccatcaagctgggtaatgacgtggacttctcggctaatcgcttcgatgaggtgatcggcaaggataatgacaccccttttccggcactttcgatggaggcaaccatacaataacgggcgtgatgatcagcgatcccgtcttgggattcatcgga

SEQ ID NO: 104 - DNA, 674 bp, Porphyromonas gingivalis
ctatctttaagttcttagacaaactactcaaaataataacgtcatgtctcaagaaaatcgtacttgtggttcgtaaataatttcataggccaatggaggattttttccctcctcacatcgtttcgccgacttggtggttttttctctactttagcgggcggaaaaattattcgcaagcatatttttcttctccccaaactctttgcttttttcgcaaatgccaaggatcgatcgaaaaatctcattctaaaatcaccaataattatcaccaatacaagtatgaaaagaagcagacttttaggccgcatcgtagtactatctctatgcgttgccacaattccggcttcggctgtcagccaaccgcagatgacgcccttgcagtcgacacacacctccgatcgttcgttcggcaggggagctcagcagatagctgacgaatggagtgccgccatgccccaaaccacatggagcagccatgctgatgtcagttggtacacggcagacggcacggaattcactctcaccactgcggagcagtttgcaggcttggccaagctcgtcaacagcggaaagtccatgaagggtgtgaccatcaagctgggtaatgacgtggacttctcggataatcgcttcgatgacgtgatcggcaaggataatgacaaccccttttccgg

SEQ ID NO: 105 - DNA, 763 bp, Porphyromonas gingivalis
agacgacaagcttgggatattgctgaagccggctcccacactggtcagtacgacgagcatgaagataccccaaaatacaccgaaggctgtggccagactgcgtctgcgattgctgtagatcgtatgccagatctctatccaacgatctctatcgaaaaatctcatagtctcctttctcctccttcgtttagtttctcatcgcctccaccgcggggattcgtacggctttgcgggcgggttggtatcctgctatggcaccgcttactaccatgactatcagagctaatagggcagtgctcaggtcgatgctcggatcgcggaagagtgtcagcgttattccttctacctgtctgctcccgacaccggtggtctgtacccaatgcgatacgaactccatcagaccaacgccggccaccaagcctatcagtccggaaaacagtgtgaccactaccgcctctgtcagaatcatgttgatgatagctcttggcttggctcccagtgctttgcgaatgcctatttcgcgctgtctttcattgacggtcacttgcatgatattggccactccgataattccgatgacaagggtgctcaacccgataatccaaagaaaaacatccatgccattgaatatcttgtccatcatttttatgtccgtcaccggtgcatcgacatagatgtgcatattagtgatggtacaggacatgatggcccgatgggcaattctattcctatcccagcaggaagtatcgtcgtggctgaacgt

SEQ ID NO: 106 - DNA, 756 bp, Porphyromonas gingivalis
  misc_feature (571)..(756): N = A, G, C or T
taggatgcagcaagatagagagcgagattatcgaactggagacatacgaagagcggcaaatgttcctcgaagagatcggtctgaaagaatccggcgtgagccgtctgatcaaagccgcttatcacttgctgaatcttcaaacctactttacggccgggagcgatgaggtaagggcttggacattcctccgcggaagcaaagcacctcagtgtgccggtatcatccacaccgattttgaaaaagggtttatccgtgccgaggtcatcaagtacaatgactttgtcagtcttggcagcgaacaagccgtgaaagaagccggtaagatgagtgttgagggaaaagaatatgttgtgcaggatggatctgtggatccgaattcgagctccgtcgacaagcttgcggccgcactcgagcaccaccaccaccaccactgagatccggctgctaacaaagcccgaaaggaagctgagttggctgctgccaccgctgagcaataactagcataaccccttggggcctctaaacgggtcttgaggggttttatgctgaaaggaggaactatatccggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 107 - DNA, 544 bp, Porphyromonas gingivalis
tcccgagtagatagagccgacagccaatgcggctataatagaccttcgtgccggctgtattatcgcatgctctggctcgactcgaagcacgcaagagcgaacccaaactatggatgctgttgggcttggcatatgcctacagcgaaaaatgggctgaagccgagagctatcttactcgcgctgcgcagcaaggccggcccggagcacaacacaagctgaacgaactgcgacgctatatgcaagacaatctctaaatggaaaaagattcttagaaaacaatattcacttttaaaacaaaaacgagatgaaaaaaacaaagtttttcttgttgggacttgctgctcttgctatgacagcttgtaacaaagacaacgaggcagaacccgttgtagaaactaacgctactgttagtttcataattaagagcggtgagagccgctgctgtaggcgatgaccttacagatgctaagatcacaaagctcaccgccatggtctatgcaggtcaagttcaagaaggtattaagacagtggacgaggacggcgt

SEQ ID NO: 108 - DNA, 392 bp, Porphyromonas gingivalis
  misc_feature (8)..(8): N = A, G, C or T
atgaatgnattttggcttctgtcttagtagtcctatcagcggattcagcaccgtgccgatttcggggcgcagtcagatcatgctggtacaggattcggagattctgtcctccagtgccttgcagtataagcagtttctcagcaaggtgaaaatctccaaaaatgcgacatccacggcacaggtgcgacgagtgggacaaaaggtagcagccgccacgatgctctatctgaagcaaaacggattgggagacatggcctcacagatgaaatgggaattcaatgtttgtagaagaccaggctgtgaatgctttctgtatgccgggcggaaagattgtggtctataccggattgctcaaagttggtacgctcggatgccgagctggccacagtgat

SEQ ID NO: 109 - DNA, 658 bp, Porphyromonas gingivalis
aagtattagacaaactactcaaaataataacgtcatgtctcaagcaaatcgtacttgtggttcgtaaatgatttcataggccaatggaggattttttccctcctcacatcgtttcgccgacttggtggttttttctctactttagcgggcggaaaaattattcgcaagcatatttttcttctccccaaactctttgcttttttcgcaaatgccaaggatcgatcgaaaaatctcattctaaaatcaccaataattatcaccaatacaagtatgaaaagaagcagacttttaggccgcatcgtagtactatctctatgcgttgccacaattccggcttcggctgtcagccaaccgcagatgacgcccttgcagtcgacacacacctccgatcgttcgttcggcaggggagctcaacagatagctgacgaatggagtgccgccatgccccaaaccacatggagcagccatgctgatgtcagttggtacacggcagacggcacggaattcactctcaccactgcggagcagtttgcaggcttggacaagctcgtcaacagcggaaagtccatgaagggtgtgaccatcaagctgggtaatgacgtggacttctcggctaatcgctacgatgaggtgatcggcaaggataatgacaacccct

SEQ ID NO: 110 - DNA, 678 bp, Porphyromonas gingivalis
tggatattacgaggcattacgcagcttgcaccaatcagaagcccgtggatatgctcacggtgacggagcagctcaaaaagaacggcaatctcgatgcggtcggcggcccctcttatatagccggcctgacgctgaaagtggcaagctcagccaacttggaatttcatgccaagatattggcacagaaagctttgagccgtgaggtaatcggcttttccagcgaagttctgaagaaagcttacgacgatacggaggacatcgaagatcagttgcagcaggccgagggacgattgttcgagatctcccaacacaacatgaagcaggacgtccagcctatcgacccgattatcaaagaggccttgggcgaaatccagattgcagccaaccgtaaggaaggactcagcggtcagccatccggtttccctgccatcgacaagctcacggccggttggcaggcttccgatctgatcatcattgctgcccgtcctgctatgggaaagaccgcattcgtgctttccatggccaaaaatatggctatcgactataatatacccgtagccatattcaatttggaaatgagcagtgtacagctcgtcaagcgtctgatgtccaatgtctgcgagattccgggtgagaagttgacgaccggtcgactcgaatcacacgaatgggtacagc

SEQ ID NO: 111 - DNA, 178 bp, Porphyromonas gingivalis
gtttatgataatacgcaagctcgccaccgaagtaatactgatgaatctggccaatatatacaacgctccagttctaggtacgatttgatctgtccgaagtggctctcggatgggtaacgtacaatggcgatcatatgtccatgtatgcctgtcaatgcagaggatagccaaagactac

SEQ ID NO: 112 - DNA, 577 bp, Porphyromonas gingivalis
cagcttttatcctccactttttgaatcttcgtgtgttgtcggtaagccgtttcggatatccatttgaatgtagtccagcgagcgtgcctgataatggacggatcgaactcttctcggccttcggacgcatgctgtatagtgccgcttccatctgccgcatcagatcgcgtttcttctcattgggatgatatacgaaaccctccaccactactacccgatctccatcgacgaaagcctgtgccacgaaaggcccggacatcatttgtcctccctccatacgccagatgccatgcacttcgcctcgcttttggtcgcccgggtagacgtagcgatgcttcagtagcatacgctccgtgacgggataagaccctgcgtccgaaccttctatattggctttgagcacggagtcacgcacctccaccatacgatcgagtcccagatccgatgctccgcgatagatctgtggatccgaattcgagctccgtcgacaagcttgcggacgcactcgagcaacatcaacaacaccactgagatccggctgctaacaaagcccgaaaggaagctgagttggctgttg

SEQ ID NO: 113 - DNA, 750 bp, Porphyromonas gingivalis
  misc_feature (683)..(750): N = A, G, c or T
gcttgggatcacaatctgaaatttctcactcagcgagatattcagctccaccttggcaaatggcacgcacaaggggcacattgtccaaaagacgattggccaagaagtcgtgtgtcttgtttccggacatcaggaaaggagaggctatatcggtcgaccacggcattgcagtcgtcctctttacagtctgcaaatcgctttcgttagcgacagcatcaagagccgttttaaccgcattatcaacattggctacgacatatactttgcgctctccggcctcggattgtgtcatatccaacttcaccttcatatcgtcaggaagccaggtccctccggtgaaagtgttaccggtaatatagtatttcgccggattcgcccctgactgatcgaacaacaagaggtaaagattggtaatgagcctttcggcagcacttccttgattcctttcatagcgtactgcctcacccgttttgatctgtggatccgaattcgagctccgtcgacaagcttgcggccgcactcgagcaccaccaacaacaccactgagatccggctgctaacaaagcccgaaaggaagctgagttggctgctgccaccgctgagcaataactagcataaccccttggggcctctaaacgggtcttgaggggttttttgctgaaaggaggaactatatccggatnnnnnnnnnnnnnnnnnnnnnnnnnnnnnnnnnnnnnnnnnnnnnnnnnnnnnnnnnnnnnnnnnnnn

SEQ ID NO: 114 - DNA, 711 bp, Porphyromonas gingivalis
cgtgttgtaccggagagatgatggcgaagtgctcggtaggacgtaccgtagcattgaaatagccgtacagattcggagtgcgtacatagtctttcacagagatctcggcttgtcccgttgttttgtccgcttccacagcggtatagatgcttccgtagcggcttctctgccatgtaccgccgagctggaggtcgaacgatttgttgtaggcgattcttccctccagattcacaccatataccttcgatactccatccttgtcgttgtagatggtacgaatgatccattctttgccatcgctcgtggtttcgaccttatcggatggtttgaactgattgctgataaaggtggagaaggcttctcccatgatattgaattgccattcgtcggctctgtggtaataatcgaaagaagcactgatgcttcgtgaacgttcttctttcagattgggggaaaggacacggctgataggagtaccaccggccaactctacgtgcagatcttcatcgaaatactgagatctgtggatccgaattcgagctccgtcgacaagcttgcggccgcactcgagcaccaccaacaacaccactgagatccggctgctaacaaagcccgaaaggaagctgagttggctgctgccaccgctgagcaataactagcataaccccttggggcctctaaacgggtcttgaggggtttcttgctgaaagg

SEQ ID NO: 115 - DNA, 358 bp, Porphyromonas gingivalis
gtgacgaactggcaagagcttacctccgaactgcaaaagcgatgtattgaagtacaattcaaaacaaatgggcaaactgagaaagtcgaatgagttattttctctatggatggtgtcagcttaaatggttcgcatatcgaccgctcatgtagctactccaaactctcttttgcgttagagcaaaatgcaaagcacgctctttctctgcctgtgctaccaaaagaggatggttttatcgaagaattgagcgaagccatagaaaagcttggagagaacctattcgacagccatgcgcctgccgtagatgttgccgaactcatattccaacgtaacctcagaaatcaagctaataagaacc

SEQ ID NO: 116 - DNA, 707 bp, Porphyromonas gingivalis
ttgcgtactacttgtgtatcgacctcaagcctttccagcgagttaatacctcgttggcttctatctccaagggattgagaatactttcatagcgacgtgtttctatgcgtccgtgagatagttccgtctgttcgtcaaggaggatatgtttctgaaaaagagggcagaaataggcttcaatctcttgcagactcaaactttgattcgctttaacacacaatacatagtttccgcccttatcgataatttgttcggcaatggcagtttgtgtacctatggcatcaatggagacaacagccccgttcaagtcaagcaaatcaagaagttgatgtatagccggtatttcgtttgtttttcggtcgatgtagagttgggcaagactgcacatatcttgtggtgaaaaggcagagacgacatgggattgtgtatcgaaagagagtttcttcactccccgcatcgtcttgccatcaatgcaaatatgtttacccgaagtgggcgagataaagccttcaatccatcgcttataagccccctcaaaagcttctacatccaacagactgatgctcctgttgagagtatcatgagaaggcatggtatgcataagctgatggccggtaagcatttcgtactagactttgcaattcttcttcgtattcctcggcataatcttcaatctcataccaagaggtattgcctgagagtgtaca

SEQ ID NO: 117 - DNA, 597 bp, Porphyromonas gingivalis
  misc_feature (555)..(597): N = A, G, C or T
ttcctggcccacgagtgtaaaacgccccgtgcgtcttacctccgtgtatgggcgcatgtcgtcatagcatttgctggcaggtcgtataggtgagtgtgttttcggcaggggtagtttccatatatcctgcacgatgcgccttacctgcgtcctgtccgtcctgcaacctgcgcagttcagcagcaggagcatatcgttgatgcagaaggagaaagcggacgctttcatagagtccatgacttcaaggcagatttccgccatctccacctccgtcctgttgcggttgctccgtataatcctgctcagggcttgcgtgtggatgagttcgggactgaaccacatacgatctgtggatccgaattcgagctccgtcgacaagcttgcggccgcactcgagcaccaccagcaccaccactgagatccggctgctaacaaagcccgacaggaagctgagttggctgctgccaccgctgagcaatacctagcataaccccttggggcctctaaacgggtcttgaggggttccttgctgacaggaggaactatatccggatnnnnnnnnnnnnnnnnnnnnnnnnnnnnnnnnnnnnnnnnnnn

SEQ ID NO: 118 - DNA, 158 bp, Porphyromonas gingivalis
  misc_feature (76)..(76): N = A, G, C or T
tgcgatttatagccgtgtctatccggactgcatattcagccagaccacggtcttgtggacaagcagctaagatgtnagttcaaaaccacggtggaaacagatactggagccctggctggctgcactgtcttcacctgatccgcagactggactgatgc

SEQ ID NO: 119 - DNA, 704 bp, Porphyromonas gingivalis
tggattctcgtcgtaaataccttcggtgtggatgttatccggagtcttcagatcgagtggatagttgccacccagataactggtagtctttagcttgggtcttcttgacggggaaacgagtcgtatcggccggagtgggagttgtatagtgattgttgatggcagtccgggcaggtacggagccactcgccggacgccatgtgaccaaaacaaggccggcgattatgggcagtagagctgcaagtagccgaatgggtttgtttttcttttccattatcaagacacccgtgatccttctttgtttgagaaaaggttataacattcgtaatgctcgcttgataatatcttcgacagctaaggacgaatcctcggagagaatggacttgaccgctttgcgtatagccggatcggcaaagccaagcatctttagagcactgatggcttcttctcccgaagctatggtattcagagcagcatctcctacagccgtccgtgcagacaagatctcgtctgaggaggtttccagttgtatcttacctttcagatccacgatgatacgctgagcggtcttcagaccgatgcccttcacggctttcagcgcatcggcctgccctgtggtaatgagtgcggacagctcttgaggagcataggaagataggatgagcttgtgccgtcgtaggcccgacaccgctgacagatgtgag

SEQ ID NO: 120 - DNA, 639 bp, Porphyromonas gingivalis
cttgggatctccggcgtataaaactttcctatgacagaagataaacgatctgcttcgtcatcgaatcttcgctgtggatgagattgcgaacccgacgctccaattcgctgtcggagttgggtagcttgatgtcgaagctgacagcaggctgcaacatggcaccattgatctgaagcaggcaattcaccggaatggtagtccgtctgacgtcgctcacgagagattcgtccaagtcgttcagattggctgtcagattgtattcggccgttacattcagagttgcgtgcatcggattgccggcaaaattcacactactgccttctttgatgctgaaacgtttttggacaatctgccggaggttgaacttataagtgcccgacaacagttccagccctccgaatacattcagatcccccaatgtatggtaatcgatacgcaaatctccatcggctgatccgcgtaagccatcgccggtctgtggatccagtatcacatccacctctgcatccggtgtcacgcctacattcatgagcaaagtggaaatccgtctccggatctcctcccgtagcaggtagaagtagagaaggacgatccggcgaagtctcttgtctcgctcgctcacggctgctctccggatct

SEQ ID NO: 121 - DNA, 822 bp, Porphyromonas gingivalis
gtaccgacgacgacgacaaggccatgggattgggcgacgcatttttcaccttttcggaagggcctcgtttggtgtctttggtttttggctcctcttcctctattttctccctttcttgttcgagacgatgcaggatgtctgtggctcgctgtacgatatggtgtggcataccgccgagacgggctacttgaataccgaagctgtgtgcactgccgcccggctccaatttgcgaaggaagagcatcttgccgtccacttcgcgagccgatacattgaagttgtgtacccgatcgagttgcccttccagctcgttcagttcgtgataatgtgtggcgaagagagtccgggggtgtgccttgggattgtcatggatgtactccacgatagaccaggctatggagatgccgtcataggtgctggtaccccgtcctaattcgtcgaacagtaccagactgcgtggcgtgagattgttcagaatattggaagcttcttgcatttcgaccatgaaagtggattcgcccatggagatgttgtccgaagctcccacccgcgtgaaaatgctgtccaccatgccgatacgtgcactttcggccggtacgaaagagcctatctgtgccatcagagagataagggccgtctgcctgagcagggcggacttgccgctcatattggggccggtgacgatgatgacttgctggatctgtggatccgaattcgagctccgtcgacaagcttgcggccgcactcgagcaccaccaccaccaccactgagatccggctgctaacaaagcccgaaaggaagctgagttggctgctgccacc

SEQ ID NO: 122 - DNA, 773 bp, Porphyromonas gingivalis
cgacgacgacaagctagggatatagtcgctattctatttttaagtcttagacaaaactactcaaaataataacgtcatgtctcaagaaaatcgtacttgtggttcgtaaataatttcataggccaatggaggattttttccctcctcacatcgtttcgccgacttggtggttttttctctactttagcgggcggaaaaattattcgcaagcatatttttcttctccccaaactctttgcttttttcgcaaatgccaaggatcgatcgaaaaatctcattctaaaatcaccaataattatcaccaatacaagtatgaaaagaagcagacttttaggccgcatcgtagtactatctctatgcgttgccacaattccggcttcggctgtcagccaaccgcagatgacgcccttgcagtcgacacacacctccgatcgttcgttcggcaggggagctcagcagatagctgacgaatggagtgccgccatgccccaaaccacatggagcagccatgctgatgtcagttggtacacggcagacggcacggaattcactctcaccactgcggagcagtttgcaggcttggccaagctcgtcaacagcggaaagtccatgaagggtgtgaccatcaagctgggtaatgacgtggacttctcggctaatcgcttcgatgaggtgatcggcaaggataatgacaaaccccttttccggcactttcgatggaggcaacccatacaataacgggcgtgatgatcagcgataccgtcttgggattc

SEQ ID NO: 123 - DNA, 816 bp, Porphyromonas gingivalis
cccagatctgggtaccgacgacgacgacaaggccatgggatggcgaaggaaaagaggctgtaaaacgtcatcgcctaagaggaaatgatcaacttaggtatgccatcttcgatgcaataaaagctgcactacccaagtgcacgaactggcaagagcttacctccgaactgcaaaagcgaggtattgaagtacaattcaaaacaaaggggcaaactgagaaagtcgaaggagttattttctctatggatggtgtcagctttagtggttcgcatatcgaccgctcatgtagctactccaaactctcttttgcgttagagcaaaatgcaaagcacgctctttctctgcctgcgctaccaaaagaggatggttttatcgaagaattgagcgaagccatagaaaagcttggagagaacctattcgacagcaatgcgcctgccgtagatgttgccgaactcatattccaacgtaaactcagaaatcaagctaataagaaactaaaacgcagaagattatgaacgaccaaatcaacgtcctcctcgaagtactcgaagaaatcaagcaacagaacagagaactcaaagcgagtatctccaatttaccacaaccaacagagtcgcaaggagaagtcgagaataggaaaaatctcgcaggaatcgccaagattttagaggagcaacaggagtttcatcgtcgattcagagaggaactttgtcaagtaattgctaaacttggagagcgcatctacgaaatgaagtcaggcattaccgaggtacggataagtcaagacgaagcgaccgacaaactcttgacagaact

SEQ ID NO: 124 - DNA, 819 bp, Porphyromonas gingivalis
tgggtaccgacgacgacgacaaggccatgggatcctgaatagccatcaaaatatcccacaggccaatgaggtcgtggagattgctccttatacttttaccattctcagatcttcttccaccaagatcgaactggtgaaaatgtccatcgacgaccaatcgaactaaaaaacaatcagttgaaaggcttggcattttgaagccggtttgtatctttgtggcttaataaacacattcttaatagtgcataataaatagaaaacataataacaaaatggcgacattagagaaaatcagaggtaaagccggtttgctcatcgtagtggtgggcgtggctctttttgcctttattatcggagacttccttcgatccggatctactttcttccgtcagagccaagaagtagtcttggatatcaacggagagaaaatcaaaatctacgattaccaacagcgtctcaaagcgatggagaaacgcgccgagcaaagtggaacaaagatcaccgacgaacagcgtgcttctctgaacaatcagctcgcacagcagtatgtacaggactacgtgctcgggcagcaagctgacaagttgggtcttacggtaagtccggaagagctattggctctgattatcggtgatggtgttcagccctccatgttcgcccaacagtttttctcccgatttggtatcaatggatccgacagggctgccgtgaatgattttctgaatcacatcagcgacaagcaaattaaattgcagccggccgaacagcaaggctatctgtacgaaatccagagtgaatggcagagcgtggaaaagcaaa

SEQ ID NO: 125 - DNA, 815 bp, Porphyromonas gingivalis
ctgggtaccgacgacgacgacaaggccatgggattgccggaagtcgaacatgcggatggccagcgtacgcggatcgttctcgggttgtccctgtttggccgcccgataggtgaagagcaggccgatcagcaggacggtgagcgagaaagctcctgccaaagctgctcctttcctgattcgcgagcctatcgtccctttttccaaaaggaaagccaaggccggtttggccacgttggtcagggtgattcctcccagcagaaaggcaaaccagcgaatggtgactccgccgaaacttccacgcatcttgtaccgaaccgacagtacagtgatggaaaggggaagcaggaagaacgagagtggatagctctcgatagtgaacggcagggtaagggctgtgaagctgccggccgacaagagggtgacgagcaggctcctcgtccgtccctgacccgccacgcggcggagataggcgtaggtggccgttacgcctgctgccgtgcacaacgtcatcaaggtcagacaaatgccgagggctaagctctctcctccgattgtgacgaatccgaaccgattgaggacatagaagaggttcaggaagggatggcttatgtcgaagacacctcctgccgtttcgaagcgatagtagttgtcatagcccagatatgcaccgatgagtccgtcgtgtggtgtcaacagtccggtggatgcgatgtgcattgtcagtgctccgtatagcaggctgagtatgcagcatagaacggcttcctctcggtaccgactgagcagtcttccgatagctccctttcgtatcattt

SEQ ID NO: 126 - DNA, 524 bp, Porphyromonas gingivalis
ctgggtaccgacgacgacgacaaggccatgggatgcagccaagatagagagcgagatcgccgaactggagacatacgaagagcggcaaatgttcctcgaagagatcggtctgaaagaatccggcgtgagccgtctgatcaaagccgcttatcacttgctgaatcttcaaacctactttacggccgggagcgatgaggtaagggcttggacattcctccgcggaagcaaagcacctcagtgtgccggtatcatccacaccgattttgaaaaagggtttatccgtgccgaggtcatcaagtacaatgactttgtcagtcttggcagcgaacaagccgtgaaagaagccggtaagatgagtgttgagggaaaagaatatgttgtgcaggatggatctgtggatccgaattcgagctccgtcgacaagcttgcggccgcactcgagcaccaccaccaccaccactgagatccggctgctaacaaagcccgaaaggaagctgagttggctgctgccaccgctgagcaat

SEQ ID NO: 127 - DNA, 784 bp, Porphyromonas gingivalis
tgtgagcggataacaattcccctctagaaataattttgtttaactttaagaaggagatatacatatgcaccatcatcatcatcattcttctggtctggtgccacgcggttctggtatgaaagaaaccgctgctgctaaattcgaacgccagcacatggacagcccagatctgggtaccgacgacgacgacaaggccatgggatcgaacccttgccgaagtacgccacatcatcggttttcgataagaccatggcggaggcgttggaaaaccaacgataactatgttagaacaaaacaaatatggatattcagattcaagggcagcttattcagatactgccactcaattcgggagtcggcaaggcttccggaaaggaatggaaaaaacaagagtacatactggaaacgctcgatcaataccctcgcaaaatacacttcagcgtgtggggagatcgtattgatccttcctatcaagtaggcgatcaggttacggtctgggtcgatattgaaagccgtgagttcaacggccgttggtacaccgatgtgaaggcttggatctgtggatccgaattcgagctccgtcgacaagcttgcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccct

SEQ ID NO: 128 - DNA, 802 bp, Porphyromonas gingivalis
ctgggtaccgacgacgacgacaaggccatgggatacccctcaaatacagggcatagaaatgtacgatatgcttcaaagcaatatgaacatcgagaaagatgctaaagccctcgacgaagagatgggcgaactctttaactacacaacccttgaggaacaaggtgtactcaacaaaactgccaacctctacctgcctatcacgttacttgttggctttttaggcatcaacacttttgttgaaaaaggatgcatcactcgcttcttcaatatcggggacccttgtccctcgacatgggggctattgggtggcgatattattacgcttatagtatttgccatctgcctctacttcccaataagacattatttcaaatacagaaaatagcatggaaatagaaactttaatcttactctgttttgtggtagtagccactgccacaattattgtcgtagccattatatggagctacaaattaaaaatcaaaaaggaggaattacgagacaaaacattgttcgaattagaacgagaaagaacaaaggatttgaataaatggcagagcttctccgaatcgttgcttgagaccaataagggactcatggaagtctattgtaaggacaatacaaaacaaaaagcatagaccacgatgtataagttggaatttgaattggaacagcatacgcccatcatccacttccaggccagggatgcaggggcaacgctgcgcgcctccgaggtcaaaccgaagctcgacaagtttatcttgacacagataggcaagaggtttgtaaagaaaactgcttc

SEQ ID NO: 129 - DNA, 800 bp, Porphyromonas gingivalis
  misc_feature (6)..(6): N = A, G, C or T
gcccanactgggtaccgacgacgacgacaaggccatgggatcttcgtgccggcaggtatccgcaggctctggctcgactcgaagcacgcaagagcgaacccaaactatggatgctgttgggcttggcatatgcctacagcgaaaaatgggctgaagccgagagctatcttactcgcgctgcgcagcaaggccggcccggagcacaacacaatctgaacgaactgcgacgctatatgcaagacaatctctaaatggaaaaagattcttagaaaacaatattcacttttaaaacaaaaacgagatgaaaaaaacaaagtttttcttgttgggacttgctgctcttgctatgacagcttgtaacaaagacaacgaggcagaacccgttgtagaaactaacgctactgttagtttcataattaagagcggtgagagccgcgctgtaggcgatgaccttacagatgctaagatcacaaagctcaccgccatggtctatgcaggtcaagttcaagaaggtattaagacagtggaagaggacggcggagtccttaaagtagaaggaattccgtgtaaatctggagccaaccgtgtcctcgtcgttgtagccaatcacaattatgagcttaccggtaaaagtttgaatgaggttgaggccttgacgacttctttgacagctgaaaaccaaaatgccaaaaacttgatcatgacaggtaagtcagcagcttttacaatcaaaccgggctccaaccactatggctatcctggtgggactgcatccgacaaccttgtttctgctggaactc

SEQ ID NO: 130 - DNA, 728 bp, Porphyromonas gingivalis
ctgggtaccgacgacgacgacaaggccatgggatcggcaccgttggcggctccggcaaattcgccgaacagctcggttccgccctgaccgaagagataggagtagtcggctgagacaagggagaaacgctccagatcggtcagagaggcaataccctgtgtgccgaccgctcgcaacaggcgcaatccgccccagtgcagatgcaggagattgaaagtcagacggagtcgatcgtccgtatagcagacggaagtgcctgcggtggtcatcgtggcagcgtttcgccgcgcgatctcggcatccgtacgatgcagcccggtgtggtaaatggctttgatggcaccgtcttcggtgacggtggcgtcgatcccctggcgcgaataaaatgccgtcagtgcccatcgtccttgtgcaagagcggtagcggccccgcgcatgaagttgtcctcggcataggtaaacgcacgtcgcagcgtggttccgccacgaggataggcgtaggccattcccatgaaagaggcctgattgacgagcaggccgtatcccatccctattcgatagtctccgagtgccacggctcgcacagcccccttcccttccatgaagaagtgggcggaatagctgtcgaagccctttcgccgcttatcgaaggccggttctccccggtctttggacgcagtaaggcctaaggaaaaacgattgcccatagcgtagctccagcgcaaacc

SEQ ID NO: 131 - DNA, 782 bp, Porphyromonas gingivalis
atctgggtaccgacgacgacgacaaggccatgggatacgaataaaaaagaagatcttatgaaaataatgaatgtgattttggcttctgtcttagtagtcctattagccggatgcagcaccgtgccgatttcggggcgcagtcagatcatgctggtacaggattcggagattctgtcctccagtgccttgcagtataagcagtttctcagcaaggtgaaaatctccaaaaatgcgacatccacggcacaggtgcgacgagtgggacaaaaggtagcagccgccacgatgctctatctgaagcaaaacggattgggagacatggcctcacagatgaaatgggaattcaatgttgtagaagacaaggctgtgaatgctttctgtatgccgggcggaaagattgtggtctataccggattgctcaagttggtaggctcggatgccgagctggccacagtgattagccatgaggtcagccatgctgtggcgagacattccaacgaacgtatcagtcaggaatatctacgccaaatgggtggtaatatactgggcgcagcagtctccaacaagtcagcagcactgcaaacggtcatcgggcaggcctatggcattggatcacaagtgcttattacgctaccctacaatcggaaacaggagtatgaagccgacaaaataggacttgtcttcatggcgatggccggttataacccgaatgcggcaattactttttggcaaaagatggctgcccaaggtaacgggcgggtagagtttctgagtacgcatcc

SEQ ID NO: 132 - DNA, 726 bp, Porphyromonas gingivalis
ccagatctgggtaccgacgacgacgacaaggccatgggatcatattttctgctgatggagtagagcgtttcctgtggccggataatgtgttcgctcggatgacgagcggcggatattttgctattggcccggaccggtttggacggaatgagcagagtctgcccttccttgatcccttgtctggccgaagggttgagcgtataaatatcatcctccgacagaccgtattggcgcgccagtccataaacggtctctttggcttgcactacgtgtacttttgtcctgctacgcgtctgaccggatgccgatactacggacatcagcacacacgtaatcagcaggatataaagaccttttatccggaatacatgatctgtcatggtttccccctttcttttttagtcctatttattattaggtgagatggggcaaaggtaacaataacgactctgcaggcaaatggttatcctctttgcaatctccatataagagaactacgtggggttaatgtcttcgttataaatcaagccatttcaatatcgaaagacatggttgcttaaggttatcccggattggtcattggaaaagtaaggcctaacgacagattccccgggtttatcgacttcagtcggttgctattgatttgggttgtggagcattcttgcgcgtgagcatcttcgagtccgtgtagatgtccgtacttgctgcgagctgcagtattgcaaa

SEQ ID NO: 133 - DNA, 740 bp, Porphyromonas gingivalis
gtgagcggataacaattcccctctagaaataattttgtttaactttaagaaggagatatacatatgcaccatcatcatcatcattcttctggtctggtgccacgcggttctggtatgaaagaaaccgctgctgctaaattcgaacgccagcacatggacagcccagatctgggtaccgacgacgacgacaaggccatgggatatatatgccctgagcggaatagggaaggtggctgccgctgtctgtgccggagaactgatctgccgctatcgtcccgactacctcatcaatataggcgtgagcggaggattggggcggaatgtcgctatccatgatacggtagtgtccacggctgtctgctatcacgatgtttcgtgcggagccgatattgcttgggggcaggtgcagggttttcccctttattatcccgtttcggaggatcttctcgccctttttcgttcgcttccggtacctgtccgagagggtgtggtctgttgtggcgatcgtttcttgtcgtcatcggaggagcaggactttgttcgtcgtacttttcccgatgccgttgccgtggatatggagtctgctgcgttggctcaggtggcatatatatacagagtcccgttcatcgccgtgcgtattatcagcgatattgccggcgaaggtcgggataactttgcggagtatatggacttctggcgcaaggcttctccggctaccttttctattctcgaaagagtat

SEQ ID NO: 134 - DNA, 761 bp, Porphyromonas gingivalis
actcgacgacgacgacaaggccatgggatgtcttgaggttcgtttcggccgaagttccgcctatcacgaatgcaatgtgatacggaggacaggcagctgtaccgagagaactcatcttatccacgaggaagttcaccagcgtcttggggttgagcagtgctttcgtttcctgatagagatacgtcttattggccgaccctcctcctttggctatgcagagaaagtcgtactccatgccgtccacggccatcaggtcgatctgtgcgggcaggttgcaccccgtattcacctccttatacatatccaaaggagcattctgcgaatagcgcaggttctcctgcgtataggtatcatagacaccatgcgagagctgctcttcgtcatgaccgcccgtccagacctgctgtcccttcttaccgaggatgatagccgtgcccgtatcttggcagaaagggagctgtcccttggctgaaacctccgcattgcgcaggaaagtcaaagccacgaatttgtcgttttcgctggcttccggatcggacagaatccgagccacttgctgctgatgctccggtcgcaaatagaaagcgatgtcatgaaaagccgtccgcgcaagtaatcgcagagcttccgatctgtggatccgaattcgagctccgtcgacaagcttgcggccgcactcgagcaccaccaccaccaccactgagatccggctgctaacaaagcccgaaaggaagctgagttggctgctgccaccgctgagc

SEQ ID NO: 135 - DNA, 782 bp, Porphyromonas gingivalis
atctgggtaccgacgacgacgacaaggccatgggattttcaagttcgggcatgacggcaaactcatcctcggccaaatcttcggaggactggccatcatcctcgctaccatcaatgtggtgggaggtttcggtgtcacgcaccgcatgctccgtatgtttagcaagaaaaagaaaggaggcgaccaatgagtcctaccatctattatatactctgcgtcctcctctctctgatggtattggggggaatatcgatgatgagccgtgtgaagactgccgtcatgggcaataccctcagtgcagtggccatgttgggcggtatcatccttacccttgtttacaatgagatcttgcctgcctggtcggtttatatcttcctgattatcggtgccggtatcggttggacgatggcacagcgtgtcaagatgatacagatgcctcagatggtggccttgcttaacggtgtcggaggggctgcttccgctctcgtggggattttgtctctcgcagctataggaatcaatccgaataataacacggctgccgactatccgatcttttcgcaagctaccggtatgctggcactgactgtcggtatgattaccctcataggtagccttatcgccgccggtaagctacacaaactactgcctcagagaccggtgatatggcctaaccactcgatgttacctctttgctactgatcctgaccgtgggattcgtggtgctcggttctgtttctatcgaagggtttcccctcttctgggctatcatcggaggactg

SEQ ID NO: 136 - DNA, 766 bp, Porphyromonas gingivalis
  misc_feature: P.g. IVIAT sequences from hydro-sheared P. gingivalis W83 genomic bank (Sheila Walters)
ctgggtaccgacgacgacgacaaggccatgggatccggagcgtaagcaaggttggcagagcgatcccaaagccgtagctttccagaacaaaagagaatacaaccgctttctgcacaatgcctggatgctcgtgggcaaatcgcagttctataatgccgatttcctgcaggcgcaggctacattttcttatatcgcacgcttatacagcgacgaaccgataatccgcgatgaagcccgtctttggcaggtacgctgctacagtgagatggggtggctgcatgaaggggagcgtttgctcgagcgcatccctaaagatcttccgcatgtcgatcgtagagggttgtattctttggcagtggcagagcgttcgatcctgtcgggtgacaagcgcgcggccataccttatctccaacaggcagcaagacaagagaaaaacaagcgacaacgcgctcgtatgtattatctgctcggacagcttttacaggaaaacaatcggccggaggaggctcgcaaggcctattccaaagtgttgcgggcttctccgcctttcgctttggactttgccgcacggatcaggaagatggagctggagggtgaacggaatccccgtacagtagccgctcgattggaacggatggatctgtggatccgaattcgagctccgtcgacaagcttgcggccgcactcgagcaccaccaccaccaccactgagatccggctgctaacaaagcccgaaaggaagctgagttggctgctgccaccgctg

SEQ ID NO: 137 - DNA, 260 bp, Porphyromonas gingivalis
gatcgatggcgaaatgcaagccgatgcagctttggtagaaagagtggcagcactcaaagctccgggaagcaatgtagcaggaaaggccaatgtacttgtattcccgacgcttgaagtcggcaacatcgcatacaaacttgtagagcgtctgggccatgcagaagccgtaggacctattctgcaaggaatggctgcacctgtaaacgatttgagccgcggatgctcggtcgaagatatatacaggatggttgccatcacgg

SEQ ID NO: 138 - DNA, 356 bp, Porphyromonas gingivalis
gatcctgtagtcgtacatggtcatggccagagtagctctttcgttgccattcttgatggcatcttcgatttcgcgcatgtcggaggacacaccgcttacgccaagtacaccgctctttttattgatcagttcagagattcctgctgcttcgaggccttctgcttccatcaggaaggtaagaacaccggggtctacgtctccactgcgcgtacccatcataagcccttctacgggtgtcatccccaatgatacgtccaaagccttgccgtttttgattgcagcgatggaagctccattgccgatatgtgccgtgattatgcgagttttgtcgtagtccaaacccaagatctcacaag

SEQ ID NO: 139 - DNA, 290 bp, Porphyromonas gingivalis
gatcgccccctcccgtaaggcccatcagcaggcccacgcctatcagggcgatgaaaatggccgtcaatggcacgggcgaaagtctttccccgaagaaaagaagcatcagagccgtgacgaacagcggatagaggaagtggatggtggtggctacaccgctggccatatagccatagccgtgaaagaggaaaagtgccgtgccggcatacaagaagcccagcaataccagcggcccgatatccgcacggctgactttgaagctgccgcccgagaggcgatgcagtataccg

SEQ ID NO: 140 - DNA, 418 bp, Porphyromonas gingivalis
gatcagttccctgccgccgcctcctctccgacaagagaggaggcggcagcggacaagactctgagtgacgagccgccctctatccggatgcagaccggcagacgagggggagggaagtcgaagagccgggcatatcgtctttcggtctcctccgtgcggcttacggtttcgtcctgctataccttattattataagtatcaatcctcaatattcgttacggcagcattcatgacatcttcacgcctctacggtcttgcggtcggtatactgtcgtccgccacattcgggctcatccccctgttcacgctgccggtttcggctaagggtgcttcgttcgagcttattctcttctatcgctttttcttcgcagccatcgccatcggtatactgcatcgcctctcgggcggcagcttcaaa

SEQ ID NO: 141 - DNA, 289 bp, Porphyromonas gingivalis
gatcgtattcttcgggaataaaccgagcaaacactcctcggcacgaacatctcctgccacatcaggcatcagtacgacctccgacagcgtccccaccgagagctgactctccacctcgaagagacggatgctttctatctcgtcgtcgaagaagtcgatacgtaccggtagctcgcgactgaaagaaaacacatccagcaaactgcctcgcacggcaaattgccccggctcatagacgtaatcggttcgttcgaagccccattccaatagaaggtctctgagaaaatcc

SEQ ID NO: 142 - DNA, 398 bp, Porphyromonas gingivalis
gatcaaatctccccaaccaatcgatattctttccctctttcgccggcacaatggtgtgcaggctttgatgaaagccctcgaccgagagaagtacgtagctctcgacgggctttgcgggtcgtcggcagcccttatagtgaaactgctacacgaatccggtcgccctgtcctttgcattgcttcggatatggaagaagccggctacctcttctccgatttggagcaactcggaggagagggtagtgcactttttttcccttcctcctataagcgtgctatcaaatacgggcataccgatgcggcacaacaggtgcttcgtgccgaggctttggccgctctttcgatggagggtagctgtccgcttgtcgtctcttatcccgaagccgtggccgaacgcg

SEQ ID NO: 143 - DNA, 291 bp, Porphyromonas gingivalis
gatccgaagccacgagagcctgcaaacgctgacgactgttctgttcggccagcatctccgcgcgccaaggcaattcgtccgaggacaagggcgatttttgtaaagcgagtgtatccaagggctgcgccaagtagtgccgcaaactctcacccaaagcaggagtatgcagcaagcgacccgaaacaagggcagcagcaatactattggcataaagagccgaagccaccgaaacggcatcttcctcgtgtacatcagtcatcacgggcaaggcctgtacggccacccaaagcg

SEQ ID NO: 144 - DNA, 334 bp, Porphyromonas gingivalis
gatctggatagtctatttccccatcgcagcggcagaccggctatgggtacaatggctcttcaagtggtgagcaatccgctttgggtggccgtacaggccttgcccgtgatgactgatgtacacgaggaagatgccgtttcggtggcttcggctctttatgccaatagtattgctgctgcccttgtttcgggtcgcttgctgcatactcctgctttgggtgagagtttgcggcactacttggcgcagcccttggatacactcgctttacaaaaatcgcccttgtcctcggacgaattgccttggcgcgcggagatgctggccgaacagaacagtc

SEQ ID NO: 145 - DNA, 302 bp, Porphyromonas gingivalis
gatcctttccaggtactcgaccagaaaggtgtaggccagctcgtaagaatggctacggagaacggccgcaaggctcgtcccaatctgaagtgcggtatctgcggtgagcacggtggtgagccttcgtctgtgaagttctgccatagagtgggattgaactacgtatcctgctctcctttccgtgtgcctattgcacgattggcagcagcacaggccgttatcgaagaaggcaaataagaaagaatacgtcagtctcttcgactcgtgtgaagaggctgacacctatcggtttattggagaaa

SEQ ID NO: 146 - DNA, 403 bp, Porphyromonas gingivalis
gatcaagccctccaaaaggaggaatgactgtatgttcaggataagcctctgaaccgagattgggaacaaaaaaggaaagagcaagcccgacgaatcggacttgctctttctccaataaaccgataggtgtcagcctcttcacacgagtcgaagagactgacgtattctttcttatttgccttcttcgataacggcctgtgctgctgccaatcgtgcaataggcacacggaaaggagagcaggatacgtagttcaatcccactctatggcagaacttcacagacgaaggctcaccaccgtgctcaccgcagataccgcacttcagattgggacgagccttgcggccgttctccgtagccattcttacgagctggcctacacctttctggtcgagtacctggaaa

SEQ ID NO: 147 - DNA, 302 bp, Porphyromonas gingivalis
gatcatccgttcggccgtttcgggcttgtttatcacaaccctctcatccgagttctgcctctccgaaagcaaaaggccgtaaacgatacttctatactcaaagatacgggaaataatctctttagacaagaaaataccgttcccattcttataaaattcgtccgtcagttcggacaggaatccacggatgcaggccggcctgaaataataggttttcgctccgccccctttggccttctgccataccaatatgctatcggcattctccgtatcggtggtgaagcgcagcagcttgtagaaac

SEQ ID NO: 148 - DNA, 396 bp, Porphyromonas gingivalis
acaaccctctcatccgagttctgcctctccgaaagcaaaaggccgtaaacgatacttctatactcaaagatacgggaaataatctctttagacaagaaaataccgttcccattcttataaaattcgtccgtcagttcggacaggaatccacggatgcaggccggcctgaaataataggttttcgctccgccccctttggccttctgccataccaatatgctatcggcattctccgtatcggtggtgaagcgcagcagcttgtagaaactccggtgcgcctccagcacggcttggtatttgcagcgttcgatattctctatgctctctttggagagcttgcgcacggcatagcgatacgccagatatgcggcaatgaagatacccgatagcttgatc

SEQ ID NO: 149 - DNA, 296 bp, Porphyromonas gingivalis
gatcaagaagattttcgatatgcgtccttacgccatcgagcaacgactgaaactccgcaatccgatatacgaagagaccgcagcatacggccacttcgggcgcgaaccctacgaagcatacaaaacctttgtcgatgagcacggaacggaacagatgcgaatcgtggagctattcacatgggaaaagttggattacgtagataagatccgaattcgagctccgtcgacaagcttgcggccgcactcgagcaccaccaccaccaccactgagatccggctgctaacaaagcccgaaa

SEQ ID NO: 150 - DNA, 448 bp, Porphyromonas gingivalis
cagcagccaactcagcttcctttcgggctttgttagcagccggatctcaggatcttatctacgtaatccaacttttcccatgtgaatagctccacgattcgcatctgttccgttccgtgctcatcgacaaaggttttgtatgcttcgtagggttcgcgcccgaagtggccgtatgctgcggtctcttcgtatatcggattgcggagtttcagtcgttgctcgatggcgtaaggacgcatatcgaaaatcttcttgatccgatatcgccatggccttgtcgtcgtcgtcggtacccagatctgggctgtccatgtgctggcgttcgaatttagcagcagcggtttctttcataccagaaccgcgtggcaccagaccagaagaatgatgatgatgatggtgcatatgtatatctccttcttaaagttaaacaaaattatttctagagggg

SEQ ID NO: 151 - DNA, 299 bp, Porphyromonas gingivalis
gatcaaagaactcttcaaggacgttcctgctcccgtgaatccagcagagcgtatctatacgccggtagaggacaacgatgagcctatcgtagccattgctaccgatgctgaggctactaccacgcagctctccatcagcttcaagagcgaccccactcctcaagaagtgcgaggatccgaattcgagctccgtcgacaagcttgcggccgcactcgagcaccaccaccaccaccactgagatccggctgctaacaaagcccgaaaggaagctgagttggctgctgccaccgctgagcaa

SEQ ID NO: 152 - DNA, 396 bp, Porphyromonas gingivalis
tataggggaattgtgagcggataacaattcccctctagaaataattttgtttaactttaagaaggagatatacatatgcaccatcatcatcatcattcttctggtctggtgccacgcggttctggtatgaaagaaaccgctgctgctaaattcgaacgccagcacatggacagcccagatctgggtaccgacgacgacgacaaggccatggcgatatcggatcaaagaactcttcaaggacgttcctgctcccgtgaatccagcagagcgtatctatacgccggtagaggacaacgatgagcctatcgtagccattgctaccgatgctgaggctactaccacgcagctctccatcagcttcaagagcgaccccactcctcaagaagtgcgaggatc

SEQ ID NO: 153 - DNA, 1000 bp, Porphyromonas gingivalis
gatccacctgatcgacaaaccccaagccatccccgaagccataaggctgctatcggccagtcgcacgatcggcttcgacacggagacccgcccttctttcgtccgcggtgctcgtccgtccgtagctctgatgcagatgtccacagaaacggactgcttcctcttccgactcaatatgatagatataccggaggaactgcaacagctactggagaatcccggcatactcaaggtaggactgagcctgagcgatgacatgacggtgatcagacggcgcaaaccgatcgaaccggcaggattcgtcgagctgcaacggctctgccctgcatatggcatccgcgatgccagtctccagaagatatacgccatccttttcggcagacgcatcagcaaatcccaacggctcaccaactgggaggcacgcacgctgaccgcagcccagcagtcctatgccgcactcgatgcctgggcttgcctgcgcatattcaatcagcttatgacacttcccacccctacccctgtacaattcgccctcttatgacagccctaccctccatcacgctactaccgaacaaagaggaatccgtcagacgattccatccgtggatcttctccggtgccatagcatcgataagcggcaatcctgccgaaggagatccaacctttcggtcagctccagtgtactcgtcgccggctgtttggtgatggtcacgagtacggcagattgtcctcgctcggaagcaaggcccaacttcggtgccttattgcccacccttacctctgccacgctttcgagcatgatgggaatatcatcgagactttttaccagtgtcttacccaatgcggcagcatcgttcgtggagaggagtccgcaaatgatatattcgttgccgtattcatacagcacgccacccgatgcattgcggttcatttggtcgacggcagcacgtacttcggccagcgtgataccgtagtgcttcatcctttcgggattgagcag

SEQ ID NO: 154 - DNA, 1174 bp, Porphyromonas gingivalis
gatcccccccaaaaaagaatcccgacgcgctcggcggaacaattcctctatcaatcgggcaggaatcgcttttgcggtcacaaaagtacgccttttttctttacagacaaatctttcaaattcttttttcaaccggttcgacaaaaaaacagcccccgaagaaaaggactccctcccaagaaagaagacaaaagggagcatatattaatatgttcgcgcgcgtaagagagacccaaaaggagcgcaaaagaaaaaaaatgagaagatgttttttcctcgcgaaaaaagtttttttgaccgaaaaaaacggcaatcggctgagaaaggaagaggatacaaaggggaggacgcaggcaaaaaacagaggttatcaatcgcacaagccaaaactcgaaccgaaaatcgcccaaatccggtctataggtcaaaacttacatgatcggaggtgtggcacaggtgacagtactcggaggcgacatcaaggaatatcagatactgctcaatcccgaaaggatgaagcactacggtatcacgctggccgaagtacgtgctgccgtcgaccaaatgaaccgcaatgcatcgggtggcgtgctgtatgaatacggcaacgaatatatcatttgcggactcctctccacgaacgatgctgccgcattgggtaagacactggtaaaaagtctcgatgatattcccatcatgctcgaaagcgtggcagaggtaagggtgggcaataaggcaccgaagttgggccttgcttccgagcgaggacaatctgccgtactcgtgaccatcaccaaacagccggcgacgagtacactggagctgaccgaaaggttggatctccttcggcaggattgccgcttatcgatgctatggcaccggagaagatccacggatggaatcgtctgacggattcctctttgttcggtagtagcgtgatggagggtagggctgtcataagagggcgaattgtacaggggtaggggtgggaagtgtcataagctgattgaatatgcgcaggcaagcccaggcatcgagtgcggcataggactgctgggctgcggtcagcgtgcgtgcctcccagttggtgagccgttgggatttgctgatgcgtctgccgaaaaggatggcgtatatcttctggagactggcatcgcggatgccatatgcaggg

SEQ ID NO: 155 - DNA, 292 bp, Porphyromonas gingivalis
gatctgataaagaataatatataatctctcactatggcgacctttgaatcttctctcaaaccccgccttatctatgtgtttgctattgcagatgcccggcacgagggtagcctcaaaataggagaaaccacccttaacgatgatgtgggttcggcttccaccgaaccgaatagtgaggtgctcaacaaagcagccaaagctcgtatcgaccagtataccaaaactgcaggtatcggttacgaattgctatataccgagctaaccatttatttctcaggtggacgtgtctgct

SEQ ID NO: 156 - DNA, 450 bp, Porphyromonas gingivalis
caactcagcttcctttcgggctttgttagcagccggatctcagtggtggtgatcgcttcgagacagcgtgcggcttcgcaacgatgactgcgttcatacagctcgtgtggatagtacggggctgagacagtggacagccaaagaaaacgatgctgaagagcagccaaccaaacgggcgactgtccccacatatccaaggtataatcattcaagggaagggcagtgtcggggatttgcagcagccgggcttcaggtttgagcggatgcgtgtcggggatagggagggttttttcaggacagaatacaaagtcctgttcgctctttgtcagccaggccggcaggagacccaaatcgcgcatcatgcttcgtactacgggtggtggtacgtagggcttcttccctatgatcataggtatagatatgtatggccgggagtgaggcataggggtt

SEQ ID NO: 157 - DNA, 298 bp, Porphyromonas gingivalis
gatcctttgactcgatatatagccattatagcacatttgtattttccacgctttttataacagagagtatactattttctcttttaatgaatatatcagatagatttttttttgtgtaaaacggattacacatcacattttttgcatagtccttaatatctatatctaatttggaaaagaatttctctatttgttctataccttctttttctttaaccatagtactagcaaatccttctttatagtagtcaatagatggggtatcattgttaaagaatctcttaaacatggaaagctg

SEQ ID NO: 158 - DNA, 1163 bp, Porphyromonas gingivalis
agcctccataatatgcgtcgcaatctggagatggtgcgcgcccgtgtggaagacctgaacgtgaaggcaccggccgacggtcagttggggcttttggacgtggagatagggcagacggtaggagccggcagtcgcatcggacagatcaacgtcctgtccgactacaaggtggaggctatgatagacgagcactatatcgatcgggtcaaagccggtttggccgcttcgttcgaacggcagggcagggacttctcccttcgcgttcggaaggtgtaccccgaagttcgggacaagcagttccgcaccgacttcgtattcgacggagagcgacccgacaatatccgcacaggccagacctactacatcaatctgcgcctcggacagccgtccgaagccatcatgatccgaattcgagctccgtcgacaagcttgcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgaattaattctt

SEQ ID NO: 159 - DNA, 1036 bp, Porphyromonas gingivalis
gatcatcaagacgacacgatcggcccgtgcagctacgtactgattgagcctgcccagcagatcggcaaaatgcctctggacagcgttctctgccactcctcccaatccgatctcattggtaacgaagatgaacgtacccgaatgcgatgtaaaggaatcgaactctgcacagagagccgcatatgcaagctccacatcggagtcgttgtcaaagaaataattagtagcccaaagcgtcagacaatcgatcaaaatcacttctccgagcggattgtggcgactcagcaccttctcttcctccatattggtccactcagagcctcgtctctcacggtgtactgccactcgctgagcgaactcatcatcccaaatcctcgccgtagccaggtagataggatgagcggacagcgctagtgccatctgctcggcatagagacttttgcccgaacgttgtccgccggtaatgaggatgattttccgatcgtttgtaggcttttggctcatatcgctgtccgaaaatagtttcgtaatgagaacaaaaataaagtatccggttcaaacttgcagaccctgcgaattgcttccatcggtattgatggaagaggccgacaggaaaaccggtgtaaaactccatgccgacacggatttccacaacaagaaagatgatgaggcttaccttgtttttttccgaaagattttggccaaaaagattttacgaaccaaaagagctgagattatggttcgtgtttttgaaaatttacgcgcgagttttttttcgttttggttcgagaaattatttttccccgaaccaaaagcaaaaaattgccgcaccacgttttttggtcccacaaatgataattttcttgtacgttcaggcttaccccaactgtccgcctgacaagaagtttctaccaccagaataccgtcgggaacttctaaccgagttgctggcagatgatacgatactcgatgatagaggttagacgagcggcgataatatatgatagggaaaagcttatccaaacaaatacatacc

SEQ ID NO: 160 - DNA, 404 bp, Porphyromonas gingivalis
tggctgtcggacagttcttttgtccatggtcattgcttcctttgttacttttggcactgcttttcttattggatgcgtggcataccaatcgctccctacgcatagccattcttgccgtaccggcctctttcgtgcagctatggggatacggtagcggatttctggttgcttgctggagatgctatgtattgggacaccaagagttcagagccttcgacaaaactttttacaactaatcccctctttttaatatcaaattttaacaccaatgcttacgaaactaaaaacactgctacttggctgctctttggcttgtattggattttcttgctccaatcatccggtattgacgaatgccgacgatgttgaacaaccattggattcgggttatatcacccttgatc

SEQ ID NO: 161 - DNA, 315 bp, Porphyromonas gingivalis
gatcacttatgaaaaaagcatttctcttaggcctcgccggtatcttcttcgctcaaacggctattgccggcaatgccgcgcaaggagttcccgacacgactgtccgaatcgaggacaaagtactcgtcatcaacgaaaccgaggacgacatcgacatcatgctctatcgttacaatcccgacggcacgcgcggacgcagcgaacaagtattcaaaggagtatatctcaaagggaggagtatcgaacagcgtttccgcaatacgatcattctctctgtcaacgagggtaaactcccatttaacaaatctactactc

SEQ ID NO: 162 - DNA, 1203 bp, Porphyromonas gingivalis
tccgtgaagatgatttcgaggccgtacgggacagactgattctggaaacactgtatgaagtgggtttgcggcgttccgaaatagccactctcaaagacaacgcggtagaagacaaggccggctgcatacgtatcatcggcaaaaggaataaagagcgaatagtacctttcggaaaacgtctgcaagatatgatagacaactatcggaatattcgtgaagaaaaagtagggaaatctgatttttttttcgtttctttggatggcagaccactgacaggtgaagtggtctacaagatagttcgtacggcattggcaaacgtaccgcacctgaccaagaggagtccgcatgttctgagacacagcttcgccaccgaaatgctcaaccacggagcagatccgaattcgagctccgtcgacaagcttgcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgcttatttttctaaatacattcaaatatgtatccgctcatgaattaattcttagaaaaactcatcgagcatcaaatgaaactgcaatttattcatatcagg

SEQ ID NO: 163 - DNA, 299 bp, Porphyromonas gingivalis
gatcctcatatccgatttccctatcatccttaatcataggaaatattaggttatgcatttcactttctttatgtgattttccaccatctattcttttacgcaaatcatcaaacaattctattattctacgtctctggcaaacataatgagccaaatcattcttagctgtttctgttacatttttcaagattttatttgcttcatcttctagtgcgctatcgcaactttcgtctcccgatgagtatttatcttgcaattcctttaatgctatccttgcattttgctctttgtcaaacttt

SEQ ID NO: 164 - DNA, 393 bp, Porphyromonas gingivalis
gatcatgaccagacgccagaaaacaagggtagccaccaatatcatcctgctcgacatccccaagaggattatcgagaaatatgctcctgtccggaaaaacggtcatctcttgccgattctctccaatcagaagatgaatgcctatctgaaagagatagccgatttgtgcaatatccgcaaacccctttcctttcatatggcaaggtatagagaattttataaacatcaaataatcaatagattatattgtatgtcaataaagggaggtaacgaaaaggaaaccagcgagcttctatactccaccttattttgccatttcaaagaaccactttttgttgattgcaaagatagtgattttttcaataatatgatagcaatagaggaattataata

SEQ ID NO: 165 - DNA, 295 bp, Porphyromonas gingivalis
gatccaccagcatgctacgacgtccatgtggaacaagaccgttttcgatgcacacgtaaacctcctgcgcacacagaccgaaaccatgtctgcagcgatagccggagtggactccataaccgtattgcctttcgatgtcacctatcagcagagcgatgacttctcggagcgtatcgctcgcaaccagcagcttttgctcaaagaggaatgccacttcgacaaggttatcgacccttcggccggatcggccggaaagatcgggggtataaatgtgttcggtgcacatgttctgtta

SEQ ID NO: 166 - DNA, 403 bp, Porphyromonas gingivalis
gatctgacaagcaaaatctccgctgtgagtgagggagatgtccgctctatcatcaatacggtaacgggccttgtcatcaccggactcaagcaaggacgggctatctcgttgggagaattgggtcgcttccggatctgtcattttgaattacaattaaattgatccggaaagccggacaatatttaaaactcttaccaactcgctttttttacgccggggataagaccggcagaagccatttcacgaaattgaatacgggaaataccaaattggcgcatatagccctttggacgcccagtcatcgagcaacgattatgcaaacgaacaggagaagcattcttagggagcaactgcaaggcttcataatttccttcagccttgagtgccgctctctttgcagcat

SEQ ID NO: 167 - protein, 753 aa, Porphyromonas gingivalis
MSLLGFFLLVLSSAGCKDDVQTDIFKGPVDYVNPYMGNISHLLIPTFPTVHLPNSMLRMCPVRTDYTSQLMDGLPLLLTSHRGANAFRLSPLNHLPDSIPAVARYTYDNEAVRPYRYSVLLDEEDVEVDFAPSFRSAIYRLGFNADSSRHYLVVHSEKGELTAEGNVISGYRYLQDSTRVFVYMETEQQPVTYARRSEKGEYIWNKGKVTGKTLVLNYDLAGTDLFLRYGISYISVAQAKKNLRQEIQAYNVEVVSKMGRNEWNKTLGKVQIEGGTILQRQVFYTSLYRTYERMINISEDGHFYSAEDHAVHPDRGIPFYTDDWVWDTYRAVHPLRILLEPEMESDMVNSYIRMALLSREKWLPTFPEVTGDSHRMNGNHAIAMLADAYAKGLTGFNLNEAYTVAKKVMAEKTYAPWRRMPKGTLDQFFDEKGYYPALPQDQKETDPTIHSWEKRQAVAVTLAIAYDYWCLSRLAQFSGHEHEAREFLRRSYDYRHLYNSETGFFHPKDEKGRFIQPFDYEFDGGPGARDYYDENNAYTYRWDVQHNLHDLIALMDGPEQFVSFLDQTFRTPMSTWKFNFYSKLPDQTGNVGQFSMANEPSLHIPYLYVYAGQPWRTQKLIHELVNEWFRNDLMGVPGDEDGGGLSAFAVFSMMGFYPVTPGLPVYVIGSPFFSKITIDLGGGNHLTIIANGAGAENKYIQKAVLNGKTLDKAWFQHSDIAQGGILELKMGPRPNKLWGVDTPPPSADPYPGD

SEQ ID NO: 168 - protein, 673 aa, Porphyromonas gingivalis
MANNGNNKKPGKPMRFNPIWLYAPVFLILATLFFVDRDITSQKELSWNEFQNIAKKQAFTDIVVNRKENTLKARVDPAKVDSVFKKGDIPSFQDRGNISDYYINTQIPSVDKFSDFYDQNQITAKVKYEDSKFSFTSILITWGPLILLLVFWFWMMRRMSGGGGGSGGGGGVFNVGKSKAKLYDKTNIHVTFSDVAGLHEAKQEVEEIVHFLKNPSKYTELGGKIPKGALLVGPPGTGKTLLAKAVAGEAHVPFFSLSGSDFVEMFVGVGASRVRDLFRQAKEKAPCIIFIDEIDAVGRARGKGNNFSGNDERENTLNQLLTEMDGFGSNSGVIILAATNRADVLDSALLRAGRFDRQIYVDLPDLNDRKEIFLVHLKPLKTDKSVDVEFLSRQTPGFSGADIANVCNEAALIAARSNKNFVDKEDFMNAVDRIVGGLEKKNKITTEEERRSIAIHEAGHATISWMLRYANPLVKVTIVPRGKALGAAWYLPEERQITTTEALQDQLCALLGGRAAEDLFLGRVSTGAANDLERVTKLAYAMVTYYGMSDKLPNINYYEMQNDGWNLTKPYSDTTAEVIDAEVNRIISEQYERAKSILREHEAGHHELADLLLKREVILADDVERIFGKRPWASRTEELLGLNAPATATEETTADAEAPIPVEGEEKTEEHPE

SEQ ID NO: 169 - protein, 151 aa, Porphyromonas gingivalis
MEIERKFLVLNDDFKAKATAVHNIIQAYLVADERCTVRIRLCNDEAYLTIKGKTNEGGLSRSEYEYSVPFEEAKEMLTLCLPGYIMKQRYCVPHKGHVWEVDVFEGRHKGLVIAEVELATEDESIELPDWIGNEVTGDKRYYNSFIAGIQK

SEQ ID NO: 170 - protein, 720 aa, Porphyromonas gingivalis
MKKRLLLPLFAVLCLCQIAHADEGMWLMQQLGRKYAQMKERGLKMKEYDLYNPNGTSLKDAVVLFDGGCTGEVVSDRGLVLTNHHCGYDMIQAHSTLEHNYLENGFWAMREADELPNKDISVVFIDKIEDVTDYVKKDLKAIKDPNSMDYLSPKYLQKLADKKAGKNFSAKNPGLSVEIKAFYGGNLYLMFTKKTYTDVRLVGAPPTSIGKFGADTDNWIWPRHTGDFSIFRIYADKNGNPAPYSEDNVPLKPKRFFNISLGGVQENDYAMIMGFPGTTHRYFTASEVDEWKSIDNDIRIRMRDIRQGVMLREMLADPQIKIMYSAKYAASQNAYKRAIGANWAIKTRGLRQNKQAMQDRLIAWGAKQGTPRYEEAVHEIDATVAKRADLRRRYWMIEEGIIRGIEFARSPIPTEDETKALQGNDASARKEAIDKIRTRYSKFANKDYSAEVDKKVAVAMLTEYLKEIPYENLPLHLRLVKDRFAGDVQAYVDDIFARSVFGSEAQFDAFAAVPSVEKLAEDPMVLFASSVFDEYRKLYNELRPYDDPILRAQRTYIAGLLEMDGDQDQFPDANLTLRFTYGQVKGYSPRDNVYYGHQTTLDGVMEKEDPDNWEFVVDPKLKAVYERKDFGRYADRSGRMPVAFCATTHTTGGNSGSPVMNANGELIGLNFDRNWEGVGGDIQYLADYQRSIIVDIRYVLLVIDKVGGCQRLLDEMNIVP

SEQ ID NO: 171 - protein, 695 aa, Porphyromonas gingivalis
MDVSAYPFFRRDMSWLSFNERVLMEAADRTLPVYDRIKFLSIFSSNLEEFYTVRVAYHQAVLQKRRDRSEAEEDSDADAHILQAIRETVIRQDELYYRIFYDQILPTLEEHGIRLRTHAPTHPDHKAYLRRFFHEEIFPLLYPMLLLPSKVRTFIRSGRVYLAVRLKEKETDEAYSYALLNVPTDGLPRFVELPRLQTDTFYYYSFLEDIIKEHLDVVFPGYEVMDSYSIKVSRDADLLLDAQRPEDLPGEIRKKVKTRKLGAPTRFMYDGRMPDEVLRYICSSCDIDPEEAIRSGNYVNLQDLAMLPNPFAPRLETLTPEPLLSKHLEQAPSLMEGIRRKDYLIHVPYYTYDYVVRLLMEAAISPDVSEIRLTQYRVAENSSIISALEAAAQSGKKVSVFVELKARFDEENNLRLSERMRRSGIRIVYSMPGLKVHAKTALILYHTPAGERPQGIALLSTGNFNETTARIYSDTTLMTANTDIVHDVYRLFRILDGDPEPARFSRLLVARYNMGEAITNLIEREIENVKRGKRGYMLLKMNGLQDKNVITQLYRASEAGVEIDLIVRGICCLVPDMPQSRNIRVTRLVDMYLEHSRIWCFHNGGKEEVFISSADWMKRNLYNRIETACPVLDPALRREIIDILEIQLRDNIKACRIDSSLNNIYKHNSDEKPVRAQAAIYRYLKGKEEATPAAK

SEQ ID NO: 172 - protein, 300 aa, Porphyromonas gingivalis
MKQRFSTIGIPLIFVLGVLLSGCYGFDPIKDKQNKLKEELNNGGSETSPTPPEGQSVFDVRFSFEKWSDTTPALPLGEGGFSSSFWASASNEGFKAMPNPTLPYPVTLADEGYQGRCVRMLTRPGIKVYGMGSYLVAASLFSGKVDVSKLISAPLEATYFGHRVRQRPIRLRGYYRYKAGSKYIDGSIGPDAVLEGKDQCTIAGVFYEVTEDTPYLNGKNLYTAPSIVSIAKVIANDTDGWQPFDLTFRSVGNKVVDLANKQYRLALVFSSSSRGDEYIGSVDSELLVDEVTLTLTTLPE

SEQ ID NO: 173 - protein, 300 aa, Porphyromonas gingivalis; identical to SEQ ID NO: 172

SEQ ID NO: 174 - protein, 281 aa, Porphyromonas gingivalis
MTLFRILFYFLLTIVGIYSPSAQEITLEAFKTDTLDKVFLNKCIYRVYYQTEIKQDTSQNLPNRGLTLLQIGSKMSKFIDFYQHYTDSLRDETARKKNHSLATSEVTNFQYSLYSKIIFRNQVFRNYPQKDINTVRLGTEFGEYFTYEEIAPRFDWEISLNEEKNIKGYRCKKATCSYRGRIYQAWYSEDIPIPMGPYVFGGLPGLIMEIRDSNNEYVFVAMAVLLIKNYDPIYRVNTPYEFLYERDKSWHEIKKSYQNLYFEIDGKILRSVTPYNPIEKD

SEQ ID NO: 175 - protein, 63 aa, Porphyromonas gingivalis
MSKYRDGVVGYGRERIGRKDRGYKCVRCTCSVIVYYPCSSIQAIGSLGSDIQLPTESFIGRQM

SEQ ID NO: 176 - protein, 1731 aa, Porphyromonas gingivalis
MRKLLLLIAASLLGVGLYAQSAKIKLDAPTTRTTCTNNSFKQFDASFSFNEVELTKVETKGGTFASVSIPGAFPTGEVGSPEVPAVRKLIAVPVGATPVVRVKSFTEQVYSLNQYGSEKLMPHQPSMSKSDDPEKVPFVYNAAAYARKGFVGQELTQVEMLGTMRGVRIAALTINPVQYDVVANQLKVRNNIEIEVSFQGADEVATQRLYDASFSPYFETAYKQLFNRDVYTDHGDLYNTPVRMLVVAGAKFKEALKPWLTWKAQKGFYLDVHYTDEAEVGTTNASIKAFIHKKYNDGLAASAAPVFLALVGDTDVISGEKGKKTKKVTDLYYSAVDGDYFPEMYTFRMSASSPEELTNIIDKVLMYEKATMPDKSYLEKVLLIAGADYSWNSQVGQPTIKYGMQYYYNQEHGYTDVYNYLKAPYTGCYSHLNTGVSFANYTAHGSETAWADPLLTTSQLKALTNKDKYFLAIGNCCITAQFDYVQPCFGEVITRVKEKGAYAYIGSSPNSYWGEDYYWSVGANAVFGVQPTFEGTSMGSYDATFLEDSYNTVNSIMWAGNLAATHAGNIGNITHIGAHYYWEAYHVLGDGSVMPYRAMPKTNTYTLPASLPQNQASYSIQASAGSYVAISKDGVLYGTGVANASGVATVSMTKQITENGNYDVVITRSNYLPVIKQIQVGEPSPYQPVSNLTATTQGQKVTLKWEAPSAKKAEGSREVKRIGDGLFVTIEPANDVRANEAKVVLAADNVWGDNTGYQFLLDADHNTFGSVIPATGPLFTGTASSNLYSANFEYLIPANADPVVTTQNIIVTGQGEVVIPGGVYDYCITNPEPASGKMWIAGDGGNQPARYDDFTFEAGKKYTFTMRRAGMGDGTDMEVEDDSPASYTYTVYRDGTKIKEGLTATTFEEDGVAAGNHEYCVEVKYTAGVSPKVCKDVTVEGSNEFAPVQNLTGSSVGQKVTLKWDAPNGTPNPNPNPNPNPGTTLSESFENGIPASWKTIDADGDGHGWKPGNAPGIAGYNSNGCVYSESFGLGGIGVLTPDNYLITPALDLPNGGKLTFWVCAQDANYASEHYAVYASSTGNDASNFTNALLEETITAKGVRSPKAIRGRIQGTWRQKTVDLPAGTKYVAFRHFQSTDMFYIDLDEVEIKANGKRADFTETFESSTHGEAPAEWTTIDADGDGQGWLCLSSGQLDWLTAHGGSNVVSSFSWNGMALNPDNYLISKDVTGATKVKYYYAVNDGFPGDHYAVMISKTGTNAGDFTVVFEETPNGINKGGARFGLSTEANGAKPQSVWIERTVDLPAGTKYVAFRHYNCSDLNYILLDDIQFTMGGSPTPTDYTYTVYRDGTKIKEGLTETTFEEDGVATGNHEYCVEVKYTAGVSPKKCVNVTVNSTQFNPVQNLTAEQAPNSMDAILKWNAPASKRAEVLNEDFENGIPASWKTIDADGDGNNWTTTPPPGGSSFAGHNSAICVSSASYINFEGPQNDNYLVTPELSLPGGGTLTFWVCAQDANYASEHYAVYASSTGNDASNFANALLEEVLTAKTVVTAPEAIRGTRAQGTWYQKTVQLPAGTKYVAFRHFGCTDFFWINLDDVVITSGNAPSYTYTIYRNNTQIASGVTETTYRDPDLATGFYTYGVKVVYPNGESAIETATLNITSLADVTAQKPYTLTVVGKTITVTCQGEAMIYDMNGRRLAAGRNTVVYTAQGGHYAVMVVVDGKSYVEKLAVK

SEQ ID NO: 177 - protein, 311 aa, Porphyromonas gingivalis
MQTSPEREAVIIRSGNSKILNTRSLMSDSRPEVLTEEDVLRLFPVLGGERRLTRRLLKALKITDINAVHARHINLRGAEFAHAALTDPAINVCYRLHGAEHLEEMRKGGAFTTVSNHPFGSLDGIMLIDIIGSVRPDYSVLVNGFLSMISCLRDSFIPVAPLKGMAGGLDSKHNVSGVKEVLNRLQNGQPVGFFPAGGISVYKGNRNRVMDSEWQASCAKMILVSQVPVYPIFFSGRNSWYFHFLGWLSWAIRTPRIPAELFNKRGHIFDVYIGDPIPPETIARFEKNPRELALFLYDRTYRLAPGHKKNK

SEQ ID NO: 178 - protein, 1102 aa, Porphyromonas gingivalis
MKRSKQLRIYTASAGSGKTHTLTGEYLRLALRTRGAFRYIQAVTFTNKATAEMKERILEELYSLAVGGSSPFAEELMQELALTTEQLQVRAQEVLTEILNDYSSLRVKTIDSFFQEVMRAFSHELGLPGGFRIEMEQKAVLEQAVVRLLHSLGEKDTSDVENWIRRLAEDLIEEGRGHNIRREIVSLGDELFKEQLLLLSEEGKLPTKAAIHRYQTEMNKLMEGFEQRRLSIARRAEEIVATAGISFYDFKGGTKGGILEFAKVLKGGEVKPPTKTFMAMAEGDPETTLYAKTTPATTQAAILSAYQSGLKECLTEMATLYLGREWQEYSTAKQSLPFLNRLGIISDLWRQIEGIRQEENKMLISDAPSLLHRIIDGSETPFVYDKIGVRIEHEMIDEFQDTSRLQYENFKPLLSESLAHGKYNLLVGDAKQSIYRFRNADRRLLTEVVSRDFAETSERVNLPYNWRSTPEIIEFNNSLYKHLPQILCEAMTREAETMAMPDPKLPEEINRTFMQTYADVEQLVPPAKVDRHGSVCIYLPSPASSEEAEANLSWEEQILQDLPRFIIGLQKRGYAPSDIAILVRKTYQAREIARAMLSYQPEPDEEDYPLIPMSDESLSLSGAASIRFLSNLLKFISRPQSDALRQIAYLSYEELRKEKGLAPTEEGNFSAAELAEFANLRRRSLYELAEGLVSFFHSYLPEREMPYLIAWLDLINDFGHERSADLHSFLQWWDETGHAKSRISSAPNSQAVTLMTIHKAKGLGFRVVLIPFLDWNLDDEAAHRHILWCKIDPARSPFNILPVVPIRYKKEMAQTMFATDYFRERADILLDNLNLLYVATTRAKDEMHLWLHPSQKPESLSTVGDLIHLALASLDENKTESDMYCWGSPVISARQKTTDHPSSGLPFTLPKGSLSAVADRLAIRPEGSEFYRRHKPLYHGHVMHRILADIVLAKDIEPALERYVSGGIVTRDEAIELVDRLSVVTSDSRLSRWFDGSGRVLNEQDILLPEGEQRRPDRIILYDDHTDIVDYKFGAVRKVHHAQMENYIRLLVSMGYPSVRGYLWYLPNNEIVGVRSVRGITRSKGEERKEGKGERGIERKAK

SEQ ID NO: 179 - protein, 204 aa, Porphyromonas gingivalis
MKVVDTRGKLCPLPLILLKKAVDGTPVGEEISVMTDNETAKCNLRDYIGELGAVAIESEEGDYTTLTFRVSTHIEEAAPTSCPAEHPHTVAQGDYLIVAKSNRMSTGNDELGSILMRAFVNAIGELDRLPSHIILYNTGVLLAVEGTDTAETLAELNKKHGIPIIVCGTCADYYEVKDKLRIGTISNMYRIMQLQVATRHIIYP

SEQ ID NO: 180 - protein, 300 aa, Porphyromonas gingivalis; identical to SEQ ID NO: 172

SEQ ID NO: 181 - protein, 131 aa, Porphyromonas gingivalis
MTVGGMQPVSIMGKHLNNFERLSILEDYLSGSDSKVAIEQKYGLSHGLIRSWLSKFGLEDKVHPVPMKVSQSPQSELPLNEKEELEQLRKENRVLKSRLKREELGHQAYKLLVELAEETYGIQIRKNSEAK

SEQ ID NO: 182 - protein, 311 aa, Porphyromonas gingivalis; identical to SEQ ID NO: 177

SEQ ID NO: 183 - protein, 1102 aa, Porphyromonas gingivalis; identical to SEQ ID NO: 178

SEQ ID NO: 184 - protein, 761 aa, Porphyromonas gingivalis
MNTKEYVLDFINRTNCNLFLTGNAGTGKTTLLRHIVQHTFKNCIVAAPTGIAALNAGGVTLHSLLQLPPGTFIPYGLSLESATGVNFLTPTSFWKQTRMHASKRKLLRNMELLIIDEVSMLRADTLDLIDFVLRRVRSNPRSFGGVQVLFIGDLMQLPPVVKPHEWELMSAIYQGVFFFHSMVIRQHPPVFLELETIYRQTDVRFTSLLNNLRHNRLPADDLTYLKDHVNPTFDSTCHEGYITLTTHNHKADQINRRALEALPALPHSYQAIIKGDFPEHLYPLEPTMTLKEGARVMFVRNDTRQPRRYYNGKIAVVHSLSPSSVVVRTDGGELIEVEPHEWTNVRYSVNPETNAPEQEVIGSFRLFPLRAAWAITVHKSQGLTFEHAAIDLEGVFVPGQAYVALSRMTGPEGMILLSPPDLRGLETPQELVEYAQTKPDEKELRTSLQENSLIYWKQQSDEAFDWQSLLNIWHKHSLSYREESELSSKSHYSDRAAEQSAKIDAITEVAGRFRRQLAGLWGQSPLGFGAVKERIDKAVDYFLPQLSAIAGELSSTIQEVGMLKKAKQFAKELLELQDNLHTAVYRLLRLRAVFGALSVGQSLSRQELRTEELMAEWVRSISPKDEALPTAAGNRKSKEKKAKEKKKTTHETTLELLLAGMSIEEVATERKLSPSTIEGHLALLIEKGRLAPDAYIDAGIVSELHPYFTNPARIFELKSLYERLNGQYSYTLLRLYRAYFILMDAKEKGSRAREKAIEQAL

SEQ ID NO: 185 - protein, 576 aa, Porphyromonas gingivalis
MWFVNNFIGQWRIFSLLTSFRRLGGFFSTLAGGKIIRKHIFLLPKLFAFFANAKDRSKNLILKSPIIITNTSMKRSRLLGRIVVLSLCVATIPASAVSQPQMTPLQSTHTSDRSFGRGAQQIADEWSAAMPQTTWSSHADVSWYTADGTEFTLTTAEQFAGLAKLVNSGKSMKGVTIKLGNDVDFSANRFDEVIGKDNDNPFSGTFDGGNHTITGVMISDPVLGFIGFFGQTNEAIIRNTIIRNATVVGSAPAGALVCNIYNKGLVSNCHAYDCRIVSAPYETSFGGSGAGSLVGGLLDESKIENCSATRVEVYSQSQSGAFISQAYNLCEVKNCFVTDSKIIADVGLIGGFVGINFAFFPGTESTFSNCYALNVEVVSLDSGDQAVLGGFVGQVSANFIAKHCYVSAKVTGGKNPGAFVGMTADESMNCKYDGCFYNNEQNPGMVGIGNGVEIPAIAGMPEAAMKTADMAAKLNADQNPAPWLQANDANNGWPYLKDNKPVITSLAAPISHEIRIWATAGRIFIAGAPAGTSVQVYDMQGHRIYNAAVLADHDIAVASGVYVVRAGDSTAKVIVP

SEQ ID NO: 186 - protein, 1706 aa, Porphyromonas gingivalis
MKNLNKFVSIALCSSLLGGMAFAQQTELGRNPNVRLLESTQQSVTKVQFRMDNLKFTEVQTPKGMAQVPTYTEGVNLSEKGMPTLPILSRSLAVSDTREMKVEVVSSKFIEKKNVLIAPSKGMIMRNEDPKKIPYVYGKSYSQNKFFPGEIATLDDPFILRDVRGQVVNFAPLQYNPVTKTLRIYTEITVAVSETSEQGKNILNKKGTFAGFEDTYKRMFMNYEPGRYTPVEEKQNGRMIVIVAKKYEGDIKDFVDWKNQRGLRTEVKVAEDIASPVTANAIQQFVKQEYEKEGNDLTYVLLIGDHKDIPAKITPGIKSDQVYGQIVGNDHYNEVFIGRFSCESKEDLKTQIDRTIHYERNITTEDKWLGQALCIASAEGGPSADNGESDIQHENVIANLLTQYGYTKIIKCYDPGVTPKNIIDAFNGGISLANYTGHGSETAWGTSHFGTTHVKQLTNSNQLPFIFDVACVNGDFLFSMPCFAEALMRAQKDGKPTGTVAIIASTINQSWASPMRGQDEMNEILCEKHPNNIKRTFGGVTMNGMFAMVEKYKKDGEKMLDTWTVFGDPSLLVRTLVPTKMQVTAPAQINLTDASVNVSCDYNGAIATISANGKMFGSAVVENGTATINLTGLTNESTLTLTVVGYNKETVIKTINTNGEPNPYQPVSNLTATTQGQKVTLKWDAPSTKTNATTNTARSVDGIRELVLLSVSDAPELLRSGQAEIVLEAHDVWNDGSGYQILLDADHDQYGQVIPSDTHTLWPNCSVPANLFAPFEYTVPENADPSCSPTNMIMDGTASVNIPAGTYDFAIAAPQANAKIWIAGQGPTKEDDYVFEAGKKYHFLMKKMGSGDGTELTISEGGGSDYTYTVYRDGTKIKEGLTATTFEEDGVAAGNHEYCVEVKYTAGVSPKVCKDVTVEGSNEFAPVQNLTGSAVGQKVTLKWDAPNGTPNPNPNPNPNPNPGTTTLSESFENGIPASWKTIDADGDGHGWKPGNAPGIAGYNSNGCVYSESFGLGGIGVLTPDNYLITPALDLPNGGKLTFWVCAQDANYASEHYAVYASSTGNDASNFTNALLEETITAKGVRSPEAIRGRIQGTWRQKTVDLPAGTKYVAFRHFQSTDMFYIDLDEVEIKANGKRADFTETFESSTHGEAPAEWTTIDADGDGQGWLCLSSGQLDWLTAHGGTNVVSSFSWNGMALNPDNYLISKDVTGATKVKYYYAVNDGFPGDHYAVMISKTGTNAGDFTVVFEETPNGINKGGARFGLSTEADGAKPQSVWIERTVDLPAGTKYVAFRHYNCSDLNYILLDDIQFTMGGSPTPTDYTYTVYRDGTKIKEGLTETTFEEDGVATGNHEYCVEVKYTAGVSPKKCVNVTVNSTQFNPVKNLKAQPDGGDVVLKWEAPSAKKTEGSREVKRIGDGLFVTIEPANDVRANEAKVVLAADNVWGDNTGYQFLLDADHNTFGSVIPATGPLFTGTASSDLYSANFEYLIPANADPVVTTQNIIVTGQGEVVIPGGVYDYCITNPEPASGKMWIAGDGGNQPARYDDFTFEAGKKYTFTMRRAGMGDGTDMEVEDDSPASYTYTVYRDGTKIKEGLTETTYRDAGMSAQSHEYCVEVKYTAGVSPKVCVDYIPDGVADVTAQKPYTLTVVGKTITVTCQGEAMIYDMNGRRLAAGRNTVVYTAQGGYYAVMVVVDGKSYVEKLAIK

SEQ ID NO: 187 - protein, 101 aa, Porphyromonas gingivalis
MDRGSPFVKGYGKYLSNAEEVCKLIRYHWAIENNLYHCHDVILGEDRSLRRKDNAAKNVNIIHKIALFFLERLKSRPKSSFNALQKINALRKPSQILSSDL

SEQ ID NO: 188 - protein, 191 aa, Porphyromonas gingivalis
MTHELISLPYAVDALAPVISKETVEFHHGKHLKTYVDNLNKLIIGTEFENADLNTIVQKSEGGIFNNAGQTLNHNLYFTQFRPGKGGAPKGKLGEAIDKQFGSFEKFKEEFNTAGTTLFGSGWVWLASDANGKLSIEKEPNAGNPVRKGLNPLLGFDVWEHAYYLTYQNRRADHLKDLWSIVDWDIVESRY

SEQ ID NO: 189 - protein, 62 aa, Porphyromonas gingivalis
MHFAPIHKEASAKNRSVVSARGFFFFSFHCSLTAESKQKKKETVPSILSSLFRKEDQEHVLL

SEQ ID NO: 190 - protein, 680 aa, Porphyromonas gingivalis
MPRRKTKKREEGLSAIDLANEEMGYVLSLIERTDQSLFLTGKAGTGKSTLLRHICATTHKKFVVLAPTGLAALNVGGQTLHSFFKLPLRPIPPNDPDLSTRDRRVFDVFRYTNEHKKLIRSLDLIIIDEVSMVRADVIDAIDKLLGIYRGRQERPFGGVQMLFVGDLYQLEPVVTADDADILKRFYPNPFFFSSEALRATPPVTVELTKVYRQTEQAFVQILDRIRSGRLTEQDLQDINKCVNRHYEPPKDEPVITLATKRRHVSYINERQLEQLQGDPVTLYGTIEGDFPSSSLPTEEELTLKQDAQVIFVSNDKDRRWVNGTLGIVAGFDQESETIDVCLSTGEVVTVEPCIWDNKRFSYNEQANKVEEEVLGRFVQYPLKLAWAITVHKSQGLTFDRVIIDFSEGTFAGGQAYVALSRCRSLEGMVLRAPLAGRDVIVRREIIDFYSRANDLEIINGSLLRAEAEREYAQALRLWNARHYTEAIGAFSQALARKNELDDPLFRRLLVSKLFEMEYARRREEELRRELAEQREVMRRLAKEYVLMGNDCITEAHDAHAAIRCYDKALTLYPDYVEALVRKGKTLAGLNEITTSLSTLNQAIAIAPMDFTARFTLGQVLEKFAYYEEALDAYRQADGLNSQSRSLLKRLIALCEELDEEDEANLYRIRLRKNRDQTGHK

SEQ ID NO: 191 - protein, 180 aa, Porphyromonas gingivalis
MAYQSKNTDEHVTFADALLSKRYRKAQNDFLNQVDRLIDWRPIRTLINKKYTKRQNAIGAPAYDVILLFKMLLPKTWYNLSDCALEERINDSITFSRFLGLKMEEVSPDHSTISRFRSALTELGLMDKLLAQFNKQLSRHHISVREGVLVDASLVETPHKPNETIAQIQLTNTEQVSLCF

SEQ ID NO: 192 - protein, 1731 aa, Porphyromonas gingivalis; identical to SEQ ID NO: 176

SEQ ID NO: 193 - protein, 342 aa, Porphyromonas gingivalis
MIFGHGDEGITPLSSEIVNFSTTVWTDGDKDHLEKHLVENLNCIRHYPEPDAGTLRQMLAKRNSVDNNAILVTNGPTAAFYQIAQAFRGSRSLIAIPSFAEYEDACRMYEHEVCFYPSNEDIGEADFSNMDFCWLCNPNNPDGRLLQRTEILRLLNDHPDTTFVLDQSYVSFTTEEVIRPADIKGRKNLVMVYSFSHAYGIPGLRIGYIVANKDFMKRVAAFSTPWAVNALAIEAAKFILIHPAQFTLPIRKWQRNTVDFITALNRLDGVEVHPSGTTFFLLRLKKGTAAELKKYMLEEYNMLIRDASNFRGLDESYVRITTQRPAQNQLFIKALETFLEKY

SEQ ID NO: 194 - protein, 743 aa, Porphyromonas gingivalis
MLNVVSKTIDLGDGRSIKIETGKLAKQADGAVTVTMGNTVLLATVCAAKDANPGCDFMPLQVEYKEKYSAIGRFPGGFTRREGKASDYEILTCRLVDRALRPLFPDNYHAEVFVNVILFSADGEDMPDALAGLAASAALAVSDIPFNGPISEVRVARVDGRYIVNPTFEQLERADIDLMVGATMDNIMMVEGEMDEVQESEMLEGIRVAHEAIKVQCKAQLELSEAVGKLQKREYSHEVNDEDLRKKVHDECYARAYEVATSGTGKHERGEAFEKIVEEFKAQYTEEELAEKAEMIARYYHDVEKEAMRRAILDEGKRLDGRKTTEIRPIWIETDCLPGPHGSAIFTRGETQSLTTVTLGTKSDEKLVDDVLNYTKERFLLHYNFPPFSTGEARPQRGVGRREIGHGNLAHRALKRMIPTDYPYVVRVISDILESNGSSSMATVCAGTLALRDAGVQIRKPVSGIAMGLISENQGKNYAILSDILGDEDHLGDMDFKVTGTKDGITATQMDIKVDGLSYEILENALEQAKQGRLHILGKIMEAQPETRDDLKPHAPRIEKMHIGKEFIGAVIGPGGKIIQGIQEKSGATVNIEEVDGMGVIEISGTNKPCIDAAIGMIKGIVAMPEVGETYPGKITSVMPYGCFVEFLPGKEGLLHISEVDWKRFETIEDTNLKEGESINVKLLDIDPKTGKFKLSRKVLLEKPEGYVEPQPRERRERREGGREGGRNFERRGGDRDHREPRG

SEQ ID NO: 195 - protein, 292 aa, Porphyromonas gingivalis
MSLQDTWGGKMNTLGDRVLLCNDKRSLPAAAVATPFLFESMLFSVCTRGYARLLIDSREIEVKEGELLVVMPRKTIEVIESSCFRAFHLCLDKEILALSAIRISGFISIINKLHSNEPFRPERMEKDFLTATLDLIRNALQNGGRHQEEIVIYLISSLFLFLDDMIADEVEKDCKHTRSETICRDFLLLVSEHHKEQHTVKFYADRLCLSSKHLALTIKTVMGQSASKVINSFIIQQAKSLLRYTDKTVQEIGYELNFSTQSFFGKYFKQHTGMSPGEYRSQEARNRQSEES

SEQ ID NO: 196 - protein, 439 aa, Porphyromonas gingivalis
MIVFLIKAAQLILAFAILVFVHELGHYFFARLFRVRVDKFYLFFDWGGAIFRYKPKRSETEFGIGWLPLGGYCKINGMIDESMDTEYLQQEPKPYEFRSRPTWQRLLIMLGGVLFNFLLALVIYSGIVLQWGSMRMPSDRISSGMAFSSVAQEAGFQNDDIILAVDGRPVDALASGFMRSVIQARQVEVLRQGRREIVHVPHDMMKRVLKANSGFMSIQVPFVIDSVMPQGTAYACQLKAGDSITAVNGKLMPDASDVIGAIRSHAGDTIALSIARAGEELTITLPVDTGGLIGVSLRPLDAIYTIDHIRYSLFEAIPAGIAQGMGTMRSYVSDMKYVFTKEGAGQIGGFGTLGSLFPASWNWPQFWAMTALLSIMLAVMNILPIPALDGGHILFLLIEIITRRKVGQEVLIRAQLIGMAILILLVLYANGNDLLRAFR

SEQ ID NO: 197 - protein, 840 aa, Porphyromonas gingivalis
MIRMETYPHNFEEKVGFDEIRRLLIGHCHSPMGSDRVIQMHALARHNEVSRLLAETEEMQIILREEDLFPDLRLADVREALNRIRPAGTYLEERELQDVATALRTIEALIRFFHVGEEEEGKDTPYPHLQTLLSEVIVFPDLEKRISSLFDRFGKMKDNASPELMNIRRELSSIEKNISRTLQGILRLAQSEGWVDQGVQPSVRDGRLVIPVAPAHKRKVRGIVHDESGTGKTVFIEPAEIVEANNRIRELEAAERREIIRILIEVCDALRPHIHDLIDCYEWIGLFDFISAKARLCGEWNAIRPILSKKPEIRWEKAVHPLLLRSLRAHGRDVIPLDISLTAPDKRILVISGPNAGGKSVCLKTVGLLQYMLQSGLPIPMSPDSTAGIFGKLFIDIGDEQSIEDDLSTYSSHLRNMKHFARHTDKNTLLLIDEFGGGTEPQIGGAIAEALLHRFNEQEGFGVVTTHYQNLKAYAEETPGLVNGAMLYDRHEMRPLFRLSIGRPGSSFAIEIARKIGLPEEVIAEATDKVGTGYIDMDKYLQDIVRDKRYWETKRTNIRKEEKRLEGAAAEYESRLESIKKERKQILDEARQQASVMLSQSSAQIEKTIRDIKEAQAEREKTRRARQELNDFRETINKEEIEKEERINREIEKIKRRKKRKQEKAASRSAETPVQPKLQEVPQPPVIQVGDTVRIKGQTAIGSIIDMNDREATIALGMIKTTVPIDRLEPAKPVKERKSEPVSGASARMIIDRIHEKRLDFKQDIDLRGMRVNEAVQAVMYFIDDAIQLGIPRVRILHGTGTGALRTVIREYLATVNGVRHFADEHVQFGGAGITVVELG

SEQ ID NO: 198 - protein, 192 aa, Porphyromonas gingivalis
MANVKLLLPYILKWEGGFVHDPADAGGATNKGVTIATWKRVGYDKDGDGDIDVEDLKLLTDDDVLNRVLKPFYWDRWKADLIESQKVANILVDWVWGSGKYGIVIPQRILGVQADGIVGNKTLQAVNSADPDELFESIFDARREFLEDITARSIKKYEDSIGRKATERELLRHTNKRFLRGWLNRLEDIRKL

SEQ ID NO: 199 - protein, 439 aa, Porphyromonas gingivalis; identical to SEQ ID NO: 196

SEQ ID NO: 200 - protein, 840 aa, Porphyromonas gingivalis; identical to SEQ ID NO: 197

SEQ ID NO: 201 - protein, 423 aa, Porphyromonas gingivalis
MGRYSYICDHMRKSLTIKNQKHRMKKTLLLAAVVVCSSFVVQAQQKSADVVENQFTTIKEVPITPVKDQANSGTCWSYSALGFLESEILRMGKPEVDLAEMHSVAQSYKDKGEKYVRMHGKLNFGQGGSFYDVLYVVKHYGVVPQSVMQGLNYGTKKNAHSELADGALAYLKAIVTNPNGKLTPAWKKAYDGIIDSYLGTCPETFTYEGKTYTPKSFAQYLGLNVDDYVSLTSYTHHPFYTQFALEIEDNWRGSLSYNMPINELMETMEYAINNGYSIAWGSDVSEVGFTRDGIGVLADVEGIEAKGSDQDRWVGLSRAEKQAEIIRTVNSADCPEINPTQEFRQKGYDEYSLTDDHGMVIYGIAKNQNGRKFFMVKNSWGETGKYKGIWYASYNFVAGRTMNIIVHKKAIPAAIAKKLGIRQ

SEQ ID NO: 202 - protein, 575 aa, Porphyromonas gingivalis
MIDLFSKLRNSDCSLRQNASNTYVHRLLSRSYLLFFLAFLQLIVNESYRRVLVSWNMEVRFADILIAPIVWSLVVYLLLAAIPSRRLYRGIMWPVILIATLMYVVEMYLLRCYGTVFIPYIATAFLATTSAEASAFWREAFSWSDIGHVAGWYAIVWLVSLTLGRLLHLLPSRPKFLFPLLLLFLSPILYAAVWHYPKALDQLSEDRGYAFSYPTAAPCERLVWSISQSLMEGKEINALFDRINSSTKRDMVTKVSPKAPHTVVLVLGESARPDYMHSYGYPLENTPRLDSLLASGAAVQFDDVVSAKPNTQGSIAAMMSIGESRAGGKWYDDPMLIPLLRSAGYYTFWLSAQEKLGFAVQNVTAIAKLSDSTLFVFRGMDDVVLPNLMQRAEYQNLFEVVHLSGSHVSYQDRYPSEFGKFTSENLPSHHDESKDAVVAHYVNSLYYTDYILGEIERKYANEDAIIIYLSDHGQVLYDAPNNPNLVGHSFSQQGVSIPLFIYLSPSMRTKYPELIPRLQSIRSRRIMTDVLPYAIMGLLGIESPLYNPELDFWGTGYDEHRPRVIYSDDSSLVID

SEQ ID NO: 203 - protein, 192 aa, Porphyromonas gingivalis; identical to SEQ ID NO: 198

SEQ ID NO: 204 - protein, 131 aa, Porphyromonas gingivalis; identical to SEQ ID NO: 181

SEQ ID NO: 205 - protein, 292 aa, Porphyromonas gingivalis; identical to SEQ ID NO: 195

SEQ ID NO: 206 - protein, 539 aa, Porphyromonas gingivalis
MADTKYIFVTGGVVSSLGKGIVAASLGKLLQARGFNVALQKFDPYINIDPGTLNPYEHGECYVTEDGHEADLDLGHYERFLNTPTTRANNITTGRIYQNVIRKERKGEYLGKTVQVVPHITDEIKRNVKLLGQKSQYDFVITEIGGTVGDIESLPFLESVRQLKWELGQNCLCVHLTYVPYIAAAGEVKTKPTQHSVKQLQEVGIQPDILVLRTEHELQPDILKKVALFCNVAPDSVVQSVDVPTIYEVPLVLQQQHMDETVLRKVGLQVGPVPEMRQWHEFLEMKHTARETVTIALVGKYVELQDAYKSIDESLMQAAIYNRKKLNLISVHSEKVTEANVAETLKDMDGIVIAPGFGSRGVEGKLIALKYARENDLPTLGICLGMQCMVIEYARNVLGFKDANTTEIESNIEHKVIDLMDEQKTVTDMGGSMRLGAYDCALRKGSKLAAAYGKEFVRERHRHRFEFNSQYREAFEKAGMQCVGENPETGLVEAVEVPACRWFVGVQFHPEYNSTVVNPNPLFMAFIREAIKTRKKDKE

SEQ ID NO: 207 - protein, 444 aa, Porphyromonas gingivalis
MRFQHYLICTAAVAALAANPLTGQSNMTLEECIDYARRHSSAVALSAAELEQSKADYLQAVGNFLPRVSAGTGASWNFGRGLDAETNTYTDINSFNNSYSIHATMTLFDGLQSVYRLRMAHARREASRLSVREQQELAALGTTEAYYDLVYARQMQELAMQKYEESSRLHRQTARMEELGMKSRPDVLEMQSRMAGDRLALTQADNQCIIALIRLKEKMNFPIDDELVVDDMPADSLSADMAESDSSAGVFARAAHHHPVLLRAKLDEQAATDRLRAARGAFLPSVSVSGGWNTGFSRFLNGSDYTPFSEQFRNRRGEYVSLNLSIPIFSGFSLVSHLRQARAERRAAIVRRGEAERRLYSEIAQAMADRDAALASYRQAKEHTDAMQTAYEAVLQRYEEGLNTAIDLTTQANRLLDARVQRLRAAMTYRLKCKLIAYYGCLSD

SEQ ID NO: 208 - protein, 65 aa, Porphyromonas gingivalis
MHTNLPVLPFGGRQDDLIRQLERSIEHLRLDRQVHSSQKAKEESDRKAAVSYNGFHRVNVVSIPK

SEQ ID NO: 209 - protein, 493 aa, Porphyromonas gingivalis
MQTKEKRGADLFPLSDKLRDSAYVRFGSAYGDIAGDYLPYNGNNYSSLSLESGGRISVRNYGTLQGSASYSRGMHKRIGWNALRNAEAYYPYLVSDSTGGDYHFEDYRLAGYYSFRAGRLPLGIGFSYRGEVAYRLTDPRTTNTTGALELSCATSLTLPRENRLSLSAAYLYHRQHLTQYNWRPGQQDKFFVSYGFGQVDVSNSPIWFGISRMNYVNGWKLSSRLDTRRGDAIGLDYSGYFLDTEERSSINLFALLYNRLRLYGSWHLSDFDFSFSADYALRQGIERIYEDYKPDDNYHIYDLRILAIRRWYMLNEFSAQAQASYRIRTDRGCALRVSAGSDFYGYDETYRKHGHHTMSGMLRPFAGIAYDHAGSKLDFGLSLSAAYRMVLTHSYKIRTIQKEQLDYQLAYLPYAYRNREGVEVRSSLYVSIPMQNTHRLMTELRLYGDLMKRKDGIAYGKTPGVISHILSDPQAERTSGHTIGAICNISYLF

SEQ ID NO: 210 - protein, 1706 aa, Porphyromonas gingivalis; identical to SEQ ID NO: 186

SEQ ID NO: 211 - protein, 1731 aa, Porphyromonas gingivalis; identical to SEQ ID NO: 176

SEQ ID NO: 212 - protein, 363 aa, Porphyromonas gingivalis
MQNAQSEKKLKIFFDGNKIFLLLPRISKFRIRRCRNIIPKYSKMKKSFVVGASLCIAAIFSLVSCSKQEIEEVRVMENETIKTDLPQARSIEDSVALAELVLDLETYNSSLDSDGRSTYSAGQQTFSVEGQLMNNRSFWSFFKKIAKAVAVVSADAIGVCVGSTIHPAMGVAFCATASAGTSVLLDADINVSFLKESFGPDITRSNYGVWHNNTIAAYLNEHGSLTNLDPLQFYNYSLTYCSNNIGSSTSRPLPYEKVETLCSALAQLFTSLENDNSEKTEEEICNMIVSAVPEIRAQEVKILLNFLLKMYSPDFKVEKRREYIAGHTEVVFQSRLSEAGKKRIYDMLSVACNSSLLWKQSEK

SEQ ID NO: 213 - protein, 326 aa, Porphyromonas gingivalis
MTATGFILAALIILVIAIIANGLKIVQQSETMIIERLGKYYRTLSSGVSIIIPFIDKPRPIRKRIAYTLPSGQNVVQFKDDTRIDLRETVYDFARQSVITRDNVVTEINAILYFQIVDPMRAMYEISNLPDAIEKLTQTSLRNVIGEMDLDQTLTSRDTINSKLREILDEATNKWGVKVNRVELQDINPPRDIRDAMEKQMRAERDKRAQILQAEGQREALIRESEGKMQESINHAEGEKQAKILRAKAEAEAKILVAKAEAEAIRQISEAVAGSGANPTQYLIAMQYIETLKDINKGDQTKTVYLPFEATGMLGALGGMKDLVKG

SEQ ID NO: 214 - protein, 336 aa, Porphyromonas gingivalis
MDTPPTVFSIIIPVYNRPDEVRELLESLLIQTNSDFEVIIVEDGSSVCCDKEVDRVRELLRIQYVRVPNGGPAAARNIGARMAVGEYLLILDSDVVLPSGYIAAVKKRIEQMQADAFGGPDAAAEGFSPIQKAINYAMTSFFTTGGIRGGRRVRLDKFYPRSFNFGCKLSVYRQLGGFSEEMRFGEDIDFSLRLFKAGYNVCLFPEAFVFHKRRIDFKKFFRQVYNSGIARIHLQRRHPGSMKPVHILPALFTLGSVILAVGQFFCPWSLLPLLLLALLFLLDAWHTNRSLRIAILAVPASFVQLWGYGSGFLVACWRCYVLGHQEFRAFDKTFYN

SEQ ID NO: 215 - protein, 292 aa, Porphyromonas gingivalis; identical to SEQ ID NO: 195

SEQ ID NO: 216 - protein, 434 aa, Porphyromonas gingivalis
MRRNRVDVITLGCSKNLVDSEVLMRQFLSNGYTVHHDPASVCGEIVVVNTCGFIGDAQEESVNTILEMVEAKKAGRIGSLYVMGCLSERFREDLKKEIPEVDAYYGKFDWKQLISHLGKSYYAEAENRRKLTTPRHYAYLKISEGCDRSCSYCAIPIITGRHRSRPMEDLVEEVRMLVKHGTREFQLIAQDLTFYGLDLYGANRLAELTARLSDIKGVEWLRLHYAYPAQFPLDLLPVMRERPNVCKYLDMALQHISDPMLGRMRRRITKAETYELIERIRTEVPGIHLRTTLMTGHPGETERDFEELLQFVRDIRFERLGAFTYSHESGTYCDKNYQDDIPESVKQERLGELMAVQERISAAHNEAKIGSRLHVVIDRAEDGFYVGRTEYDSPEVDPEVLIPFVSGQELNPGRFYMAEVTGAEPFDLYARIVD

SEQ ID NO: 217 - protein, 202 aa, Porphyromonas gingivalis
MITIGITGGIGSGKSVVSRILLTLGIPVYDSDSRAKWLNDHSPVVRQALTGLIGSDLYENGILRRDRLAAAIFSSGDLLEQVNGIIHPEVKKDFCQWRSECESDLCAIESAILFSSGFNSLCDTVIRVDAPEKIRQERAMARDGSSAETMRQRMLSQEREQSLAKAGADHTVLNAPPHLLVPQVVRIIETVRTKRPNPPDRL

SEQ ID NO: 218 - protein, 335 aa, Porphyromonas gingivalis
MKLNLLNADRKKGKSIDKASAPRSRRGRNVLVFFAFVVLSAVFWFMQSLQDVYTTSFSIPISYSELPPDIGVSGRLPDRLDIMLKDQGIVLLTYKLKGFSPINISPSKAQLHKKKSMRLNKWDLVELLQKQLETSTTVAAISPEDIKATFYTRKKKTVPVVINGQTVPKEGFYAFDPIFSPSEVTIYGSAEALASIGSVNTEEFSIDGLESDFSGDIAIAPIDDIVIDPTNIRMQVRVEQLTEQTFELPIITKNVPEGFLLRPLPGKVSIQLTLPTSHYKEVSEADLQTAVFYPSSPDSLRSDSSLPVELIMKPDWLKHYKITPSHVQFIIERIQ

SEQ ID NO: 219 - protein, 319 aa, Porphyromonas gingivalis
MAKILVAFNTVSEGFDRLTARHEVVFPPKGRDFTQEEIAERIVDCDVLCSVFDIPIGRDLIDKGRSLKLIANYAVGYNNIDVTYAASKGIVVTNTPRAVIEPTADLALALLLSCTRRIAEWDRLFRRDGEMVERGRLCRLGVNLYGKTLGIIGFGNIGAAVARRCKAFGMNVLYNKRTRLSEAEEKAQGITFADKDDLIRRADVLSLHTPLTPETKHLIGTAELSMMKPTAILINTARGAVVDERALVEALREKRIAAAGLDVFENNDIPSPELFAMDNVSLTPHVGTQTYDSRVEMVHELCDNVLGFLHGDRPISRVN

SEQ ID NO: 220 - protein, 658 aa, Porphyromonas gingivalis
MSYLKFDKTLMANLDESLQREYIRTNRKGAYSSSTIVGCNTRKYHGLLVVPIPELGDQNRVLLSSLDLTIIQHGAEFNVAVHHYKGGVISPNGHKYIREYNVDIIPATIFRVGGVVLKREQVFCHYINRAIFKYTLMEAHSDTLLRFRPLLAFRSVAALTHENGQIERGHIPARNGIGISLYKGYPHLFMQFSKEPEYREEGYWYKDFEYPKEKERGYECTEDLYMPGTFEIPIKKGESIYFAAGLEEANPNTLRTTFVKEVRERIPREDFFSCLRNAAHQLYYRPTPDDGYLLAGYPWFDVRARDLFVALPGCTLCVEAPERFERIVNTVIPAMERYMRLHEDDDTIHGLHEPDVGIWAIWAIQQYARRNGLEAAKRFGSFVSEVVSYYLSAQHPTAQIRENGLLYVLGTGFPLSWMDAKLNGKAVIPREGYLVELNALWYNALCFERELNGEKPEIGEIISRIERSFPDTFLNCYNYLFDYVQDGKAQDWSVRPNMLFAISLPYSPLQRDRQLQVLEIITRELLTPKGLRSLSPKSEGYRPYCRGKQEERELAYYNGSVWPWLLGQYTEAYLRLYGNSGVTFLERMLIGMEEELQMHGIGTISELFDGNPPFMGRGAISFAMSVGEILRAKELLNRTESDMHLSVRHMYNYTKWKG

SEQ ID NO: 221 - protein, 1706 aa, Porphyromonas gingivalis; identical to SEQ ID NO: 186

SEQ ID NO: 222 - protein, 1731 aa, Porphyromonas gingivalis; identical to SEQ ID NO: 176

SEQ ID NO: 223 - protein, 1160 aa, Porphyromonas gingivalis
MLLRNTLIDNSSPELSMSSCLKQCFRLDWVNRVRIATGYWDVPGMALVIKELSAFLEREGTMLQILIGKDPYVYSSLLKNPKYQDASFPHDFIRTDIHNLELHEEYMQVIKLLLKHCESSKIQIRIYLRNAQGEIEFLHSKCYICSGVDDSLGIIGSSNFTSRGLIGNAELNYLESDSRVVTAKPQKGSAAKGHSHWFDEKWTIAEDWSQEFLEQVIKTAPIAQETMKSAKQEMQEQSLSPYELYIKLLQYKFSSLVDKDLNEILTGYLPSTFDAFEYQLDAVKQCYSIMQEHGGFMLSDVVGLGKTVVGTLLVKHFLSMPEDDGRNKRVLIITPPAILETWRETIDLFDVDKPESIAPSIDFVTMGSIGKLVDDIEDEDELNLEELDSGEFIEPLPCANYGLILIDESHRLRNNHTQMYQSLDTLIEQIVLREGAYPYIGLLSATPQNNRPDDLKHQIYLFQRNHTDSTLRKANGGNLESFFADIAREYQSVIYSRYDEGPTAEQIQQSRKLLNDLSSRVRDCVLQDILVRRTRTDIRKYYPETKLTFPEISGPHSFEYRMSKSLAKLFARTMDCIAPKENFQFDSSTSLCYYRYRAIEYLRDESTRKLYSGRNMDAERFSHQLARIMQIGLVKRIESSFSAFKVSLKNLKRYTQNMVDMWEHDTIFICPQIDVNAELNPRKHWDSTRKLFSFEECAEDLRKKINKLNSSGSNEKGRNREYRREDFAPEYIDLLRQDLALIDQLDEQWSIYSDDPKLDDFKRQLLPSLLSLERNPEQKLVIFTEAIDTVRAIERAIESVDDRLSVLSITAKNRREREEDIRANFDANYKGEQRDDYQIIITTEVLAEGINLHRANSILNYDTPWNATRLMQRIGRVNRIGSQAPCVYVYNFMPSAEGDAEINLVKKAYTKLQSFHTLFGEDSQIFSEEEEVVHHELKTQIEGAESALEQYLYELKTYKAQHPERYDYIARQSEGLELAVSETEGQALFVVRSPKCPAMFVRYDALEDKCSMLSAPQMYEAFRSATFGAQASFALPKDWQARRDAAVLAVNQALVKRNLNMKRSARATEAKAIIDQMKEMPMEAHSRKLLASARKLVDKGNPDIIKRIIGIGHLLKEREGSLLPITQDEIDTIIHKEIEILVSGIAKKFGQAEVFIGLSL

SEQ ID NO: 224 - protein, 1132 aa, Porphyromonas gingivalis
MELKQYLQQSYQGIESFLEKIVFPIFGQELFEDGHGVSILEMYPDLRPAAQATGILEIKHIGNIDMDFNPINIFDITVSSQIKMARNKVGIQNIIRRIMDTYSSAFMIFHYEDNPLWEWRFTFCHKGRSQSDITSSKRFTFLLGPGQHCRTAADNFQKLIDKKQRQDIELKDIEDAFSVEALTKQFYKDLFEWYQWAISPEADISFPNDTSTSEDDREDLETKIIRLITRIMFVWFIKQKELVPQHLFDIAFLKTILKDFDPNSTTEGNYYNAILQNLFFGTLNRARQDEDGKPRRFATGSKRDVKTLYRYAELFSISEKEVIQLFDSIPFLNGGLFECLDKTRYIDGVERCYSLDGFSRNDTRFANGRFKHRATIPNNLFFAPERGLVSILSRYNFTIEENSPEEQQVALDPELLGKVFENLLGAYNPETQETARNQSGSFYTPREVVNYMVDESLISYLGDSDLVRSLFRPDFVLQEDNKVQCEAIASKLKAVKILDPACGSGAFPMGLLNRMIELLERISPQEKSYDLKLFVIENCLYGSDIQSIAAQITKLRFFISLICDCERDETKPNFGIPTLPNLETKFVAANSLIAKKKMAQHRNLFEDPAIEETKNELIGVRHKHFSAKSTSAKLRLREQDQDLRKKLAQLLAENEDFAPEDALQLAAWNPYDQNAVSSFFDPEWMFGLADGFDIVIGNPPYVQLQNNGGELTKLYQGCDFKTFARTGDVYCLFYERGWQLLKEGGHLCYITSNKWMRAGYGEKTRLFFASKTNPKLLVDFAGVKVFESATVDTNILLFAKEANAGQTQAVSLNKNVQIGGSELCEYIQQHATASAFISSESWVILSPIEQSIKRKIEAVGKPLKDWDINIYRGVLTGCNEAFIIDEDKRNEILNNCQSEDERKRTEEIIRPILRGRDIKRYSYDWAGLYIVYIPWHFPLHLDSTITGASEKAEDAFKASYPAVYRYLEGYKDLLTKRNQAETGIRYEWYALQRWGANYWEDFSKPKIMWKRIGSILRFCYNENGALGLDSTCFAAGKGAEFLCCLLNSPMGHYLLKDSPKTGTGDLLISIQAVEPIKVPPITETLIRSFKALLTNVCQIGTEEQETSINHQIFSLYNLSEEEQRYIKNNFSH

SEQ ID NO: 225 - protein, 1193 aa, Porphyromonas gingivalis
MAKEKKFLTCDGNQAAAHIAYMFSEVAAIYPITPSSTMAEYVDDWAAAGRKNIFGETVRVQEMQSEAGAAGAVHGSLQGGALTTTFTASQGLLLMIPNMYKIAGELLPCVFHVSARTIASHALSIFGDHQDVMAARQTGFAQLCTGSVQEVMDLAGVAHLATLRTRIPFIHFFDGFRTSHEIQKIEALDNEDLARFIDWDDVKRFRKQALNPESPVTRGTAQNGDIYFQNREACNRFYDAVPEAVQYYMDQLATVTGRHYHLFDYYGDPEAEHVIIAMGSVTEAIREVIDFLRAKGEKVGLLSVHLYRPFSAKHFLAAMPKTVKRIAVLDRTKEPGATGEPLYLDVRDCYYGMEDAPLIVGGRYGLSSKDTTPAQMKAVFDNLKLNVPKDHFTVGIVDDVTFTSLPLGEDLIFDNPSLVEAKFYGLGADGTVGANKNSVKIIGDNTNKYCQAYFAYDSKKSGGFTCSHLRFGDTPIRSTYLVVTPDFVACHVPAYLRMYDVLKGLKKKGTFLLNSIWAPEDIEQHLPNKVKRYLAKNNIRFYTINATAIAQQIGLGNRTNTILQSAFFKIANVIPYDLAVEQMKKFIVKSYGKKGEDVVNKNFAAVDRGGDVVEITVKPEWADLPDDPVVRHEGDTDFVHNVVRPINAQAGDDLPVSAFLGREDGTWDSGTAASEKRGVAAFVPVWEADNCVQCNQCAYVCPHATIRPFVLTKEEEEKTGVKVLKAVGKQFPDMGFRIQVNVMDCLGCSNCVDVCPGNKNGKALTMQPIEEQYEEQKNWDKMISGVTGKAHLVDIAANVKNSQFATPLFEFSGACSGCGETPYVKLITQLYGDRQTVANATGCSSIYSASAPSTPYTKNERGEGPAWANSLFEDNAEFGLGMHLAYKKMRRRLVNLAEEAQQSPCCSDELKALLREWVEKRQDAVASKVLADKIKPLVAACDCDICKRIGRVDSFFIKRAQWIIGGDGWAYDIGFGGLDHVIASGMNVNILVLDTEVYSNTGGQSSKSTPIGAIAKFAAAGKRIRKKDLGMIAATYGYVYVAQVSIGANPAQTLKAIREAEAYDGPSIVIAYSPCISHGIKSGMGKTQAEGKRAVECGYWHLWRYNPELEKEGKNPFQMDSKEPNWSEFKNFLKGEVRYASLYKEFPEDAEQLFDAAFENAQWRYRNYMRMSAADWSLPLGIQDIKEEKDCDH

SEQ ID NO: 226 - protein, 757 aa, Porphyromonas gingivalis
MRTKTIFFAIISFIALLSSSLSAQSKAVLTGSVSDAETGEPLAGARIEVKHTNIVAGADAGGHFEIKNLPAGQHTIICSLGGYGQKEEVVAIEAGQTKTISFALRLRTNNLEEVVVTGTGTRYRLVDAPVATEVLTAKDIASFSAPTSEALLQGLSPSFDFGPNLMGSFMQLNGLSSKYILILIDGKRVYGDVGGQADLSRISPDQIERIELVKGASSSLYGSDAIAGVINVITKKNTNRLSAYTSHRISKYNDRQTNTSLDINIGKFSSNTNYFFYHTDGWQNSPFEIKKKKGSGEPVLEETYKKTFRAQENQGVSQSLSYYATNNLSFSGNVQYNKRQIFTPTFSEKKAYDMDYRALTASLGTNYLFPNGLHTLSFDAVYDRFRFGYLYHDKDSSESLINNQGQTEQPTFFPGQLRNKNDQIRYTAEARGVFTLPYAQKLTGGLEYFREELISPYNLITDKADASTLSAYVQDEWKPLDWFNMTAGFRLVHHQEFGTRMTPKVSILAKYGPLNFRATYANGYKTPTLKELFARNELTTMGSHNLYLGNADLKPQMSDYYALGLEYNQGPISFSATVYDNELRNLISFMDIPTSPEHEAQGIKKTKQYANIGKARSRGLDVLCDASIGWGIKLGAGYSLVEAKNLQTDEWLEGAARHRANVHADWVHYWGQYRLGVSLFGRIQSERYYKDGNAPDYTLWRLATSHRFAHFRHIILDGTLGIDNLFDYVDDRPMGVNYATVTPGRTFFAQIAIRFNN

SEQ ID NO: 227 - DNA, 927 bp, Porphyromonas gingivalis
ctggcgcgacgaccacagccttgggatctgaaagagctttttgcacggaattgaactcaccactatgggttcgcacaatctctatctcggcaatgcggatcttatagccacagatgtcggattattatgctttgggcttggagtacaatcaaggccctatctcgttcagtgcaacggtttatgacaatgaacttcgcaatctgatctcctttatggatataccgacctcacccgagcacgaagctcagggaatcaagaaaaccaagcagtatgccaacataggaaaagctcgcagccgcggccttgatgtcctatgtgatgcctctatcggttggggtatcaagttaggagccggatacagcctcgtggaagctaagaatctccagacggatgagtggctggaaggagctgcacgtcatcgtgccaatgtgcacgccgattgggttcactactggggtcagtatagacttggcgtgagccttttcggacgtattcagagcgagcgttactacaaagacggcaatgctccggactataccttgtggcgactcgacacatcgcatcgtttcgctcatttccgccacatcatcctggatggaacgctcggaatagacaagctgtttgactacgtggatgatcgccctatgggtgtccattatgctacccgtaacgccgggacgtacatcactaggacaacaacgaaacgaaccacaacaaagttcaaaaaccaataacgaaaagagaaaccctgattacgcacctcggacactcacaggcagaccacgtaaccaaccagactgaacaacgagcacatagaaacagaaacaaagacaacacacgaaaaaacaccaaacaaccagcaaaaactcacaaacacacaaacacaagacgaaaaaacaaagacaacaacacagaaaaactacaaca

SEQ ID NO: 228 - protein, 581 aa, Porphyromonas gingivalis
MIRKLILLLALMPVASVAFAVPTDSTESKDNRILTSMQSSSLNRDDAPDKWQPMHANFSIQSDMLLSTAQKSKNTWFGNSYIMGIIKNNYLEFGARFEDLYKPLPGHEPEMRRGVPHMYVKGSYHWAELTMGDFYDQFGSGMVFRTYEERNLGIDNAVRGGRIVLTPFDGVRVKGIAGQQRNYFDRTGKVFNSGRGYLLGSDLELNVERWSSAMRDNDYHLAIGGSFVSKHEADEDIFVGVGEDRKRLNLPLNVPIMGLRTNFQKGGLALYAEYGYKYNDPSADNDYIYHDGQAALLSASYSKKGMSILLQAKRCENFAFRSKRSAQLTPLMINYMPAFTQAHTYTLAAIYPYATQPQGEWAFQGELRYNFARRTALGGRYGTGLRINVSHVRGLDKKMLKENPDELIGTDGYTVSFFGMGDLYYSDIDVEITKKVSPGFNFTLTYLNQIYNNKVLHGAAGEKPEKIYANIFVYDGKYKLSNKVALRTELQYLHTKQDQGDWIYGMAELSILPSLMLSLSEQYNIGETKKHYVMGSVTYTHGAHRVAFSAGKTRAGMNCSGGVCRVVPETQGFYLSYSTNL

SEQ ID NO: 229 - protein, 160 aa, Porphyromonas gingivalis
MKCFFIALIGLLFSLNTYAQLPAVSLKNIEGKTVQTNKLENAGKPMIISFFATNCKPCLRELKAIQEVYADWQDETGVRLIAVSIDEGQNAQKVKPLADGNGWEYEVLLDSNGDFKRAMNVSLIPAVFIVDGNGKIVYNHTGYTEGGEAELIKKVRELVK

SEQ ID NO: 230 - protein, 115 aa, Porphyromonas gingivalis
MKYFQEADIAVTVCDKTGKIIDMNEQSRQVNLKPGQELIGSNVLDCHPEPARSMLEEMMRQERKHVYTIEKNGRKKLIYQIPWYEKGEYMGFLELSMVIPFEMEHKIRTPKPAND

SEQ ID NO: 231 - protein, 1075 aa, Porphyromonas gingivalis
MIDKSKIKKVLLLGSGALKIGEAGEFDYSGSQALKAIREEGIRTVLVNPNIATVQTSEGIADEIYFLPVTPYFVEKVIEKERPDGILLAFGGQTALNCGVELYRSGVLEKYGVEVLGTPVQAIMDTEDRELFVRKLDEINVKTIQSQAVESVEEARKAARELGYPVIVRAAYALGGLGSGFCDDEDELNILCEKAFSFSPQVLVEKSLKGWKEVEYEVVRDRFDNCITVCNMENFDPLGIHTGESIVIAPSQTLTNSEYHKLRELAIRIIRHIGIVGECNVQYALDPDSEDYRVIEVNARLSRSSALASKATGYPLAFVAAKLGLGYGLFDLKNSVTQTTSAFFEPALDYVVCKIPRWDLGKFHGVSRQLGSSMKSVGEVMAIGRTFEEAIQKGLRMIGQGMHGFVENKELVIPNIDKALNEPTDRRIFVISKAFRQGYTVDKIHELTKIDRWFLEKLYGIVTLAEEMEEFDKLEDLSPALLAEAKLRGFSDFQVARAVLKPDATSMESATNQVRAMRKELGILPVVKRIDTLAAEYPAHTNYLYLTYSGDRHDVAYENDKRSVVVLGSGAYRIGSSVEFDWCGVNALATIRKEGYRSVMINYNPETVSTDYDISDRLYFDELTFERVMDILELENPHGVIVSTGGQIPNNLAVRLDEQHVPILGTSAQSIDNAEDRHKFSAMLDKLGIDQPRWQELSSMDDIDGFVAEVGYPVLVRPSYVLSGAAMNVCSNDEELHRFLELAANVSKQHPVVVSQFIEHAKEVEMDAVARDGEIIAYAISEHIEFAGVHSGDATIQFPAQKLYVETVRRIKRISREIAKALKISGPFNIQFLAKGNDIKVIECNLRASRSFPFVSKVLKINFIELATRIMLGLPVEKPNKSEFDLDYVGIKASQFSFTRLQKADPVLGVDMTSTGEVGCIADDTDEAVLKSMLSVGYRIPQKSVLLSTGGYKQKVDMLDATTMLAAKGYKIYATEGTHNFLRENGIESTKVFWPSENGQPQALELLHNREIELVVNINKNLTAGELTNGYKLRRAAIDLNIPLVTNARLASAFITAFCKHSPEDIRIKSWAEYK

SEQ ID NO: 232 - protein, 153 aa, Porphyromonas gingivalis
MKEKIQKNILIKNKRATFDYEILDVYTAGIVLVGTEIKSLRLGKGGLVDTYCYFHRGELWVKNMYIAEYFYGTYNNHVARRDRKLLLNRKELRKLEEASKSMGTTIVPLKLFINERGLAKLQIGLARGKKQYDKRASIKERDDRREMDRALKR

SEQ ID NO: 233 - protein, 501 aa, Porphyromonas gingivalis
MKKKSLFLLSLCFASLGPTPWSEVSAQQVAAADPSPLSLTEAIRLARKQSVDAAVALQELRAAYWQWRTYRAELLPGVNLTATLPDYRRAYSLYQQPDGSYSFVRSNALRLSGHISVDQNIWLTGGKLSLVSSLEHINPLGTEGADRHFMSVPISLTLSQPLFGLNEMKWSRRIEPVRYEEARRRFVANTEEVSVSCIDHYFSALLAREEYNNAETNLRNTAKLVEVARAKKKIGKLSENELRAVEISYASASSAILSSRTALRGAEMSLSIFLGLQPDEVLSLSIPADTIFTPVSYERVMELAGRNHPFVGEMKRRMLEADRSLARAKSERFSIELMAQIGYAGQADNLHDAYGGRLKDNSSVSVGVRIPLVDWGRGRGRIRLAESNRRLEEHRLRQEEERWHRQIFLLVEKHNNQLRILELARRTDSIAQARYHTAVETFTVGAISTLDLNAAQDAKDLARTSLVRALHHYWSYYYNLRSLTAYDPVRDEEIDIPMEEL

SEQ ID NO: 234 - protein, 353 aa, Porphyromonas gingivalis
MKGNEALAHSAIRNGVDGYFGYPITPQSEVMETLMEEHPWDTTGMVVLQAESEVAAINMVYGGASCGKMVMTSSSSPGMSLKQEGVSYCAGAELPCLIVNVMRGGPGLGTIQPGQADYFQSVKGGGHGDYRLITLAPNSVQEMVDFVGLGLELAFKYRNPALILSDGIIGQMMEKVILPPFKKRRTEDEIRKQCPWATLGRKGGRQPNIITSLELDSAVMEQNNLRFQKKYAEIEANEVRYEEYQTEDADYILVAFGSSARICNKTVQLARQQGIKAGILRPITLWPFPTKEIAKLADRAKGFLVAELNAGQMIEDVRLAVNGKVPVEHYGRMGGMLFSPDEILQALKEKVIK

SEQ ID NO: 235 - protein, 313 aa, Porphyromonas gingivalis
MHKSFRSLILLLLLTVAGGEDIFAQGDLLLAQYTRAYGYYNPAYAGMRKEIFITALHNRQWEGMPRSPKSFVVLADAPIRFFDREHGVGVRVVTETRGLFAINELMGQYAFKQKLFGGDLSVALQAGLVNTAFDGTKVELETENDPAIPLTKVSGKAFDIGAGIYYRRKELYVGFSSTHLTAPAIPLNEQYILDLTRHYYLLAGYNIRSIYSLFAWHPSIFAATDGHSSRLDVTMGMSYNNRFFASLMYRPTQAVGVSLGMQLGKFYAGYAFEWPTSVLAKASWGSHELLVSYSFPLSNTKNRDAKYKSIRFL

SEQ ID NO: 236 - protein, 491 aa, Porphyromonas gingivalis
MCRKNRFFALAGFFLFGVFTISSCGSSKRAVGGELTGAKLSSWNEPSPFGMIQVPRGSIVLGNKEADSLWGIPAESRPISVDAFWMDRTEITNAQYRQFVYYVRDSIIRERLADPAYGGNEEYKITENKFGEPVTPHLDWSKPIPSEKRATEEEIAAINSVYYTNPVTHDRKLNPDQMVYRYEVYDYRSAALREHQLKAAKRNLNTDIKVDPNAVVMISKDTAFVDESGNIISETITRPLSSEYDFLNTYIVPIYPDETCWVNDFPNARTEIYTRMYFNHPGYDDYPVVGISWEQAQAFCAWRSEFFRKGIRLPEGQIMDDFRLPTEAEWEYAARMGDSNNKYPWSTEDLRTGRGCFLGNFKPGEGDYTADGHLIPSRVSSFSPNDFGLYDMAGNVAEWTSTAFSESGLKQMSDINPELEYKAALTDPYILKQKVVRGGSWKDVARFIRSATRSHEYQNVGRSYIGFRCVRTSIAFSSGKAPKSSRRSTKK

SEQ ID NO: 237 - protein, 365 aa, Porphyromonas gingivalis
MDFKDILRQLSERIEKLRDNLQTEEATKNALIMPFIQAMGYDVFNPLEVIPEFTCDIGTKKGEKIDYAIMRDNEPIILIECKHWRDTLTLADNQLLRYFHVSSAKFGMLTNGIIYRFYTDLDQANKMDEKPFLEVNMLDLRDNQIEELKQFHKSYFDVDKILSTASELKYMKELKDLILAEMNEPSEQFVRMLAKQVYDGIITAKIFEQFKDLTQKSFKSVINDLITARFKTVMDKSKEVAASEEQSQEQDDSNEPLVVTTEAEMEAYMIVKGILRKYINIDRIASRDTQSYFSVLLDDNNRKPICRFYFNTANKYLATFEEGKKEVKTLLNSLDDLFMHEKSIAKSLALYVDTEESALIVKSKE

SEQ ID NO: 238 - protein, 192 aa, Porphyromonas gingivalis; identical to SEQ ID NO: 198

SEQ ID NO: 239 - protein, 1706 aa, Porphyromonas gingivalis; identical to SEQ ID NO: 186

SEQ ID NO: 240 - protein, 515 aa, Porphyromonas gingivalis
MAQQEDLFKKIVSHCKEYGFVFPSSEIYDGLAAVYDYAQYGSELKNNIKRYWWESMTLLHDNVVGIDSAIFMHPSIWKASGHVDAFNDPLIDNKDSKKRYRADVLVEDHLAKIDEKIAKEVAKAAKRFGEAFDEAQFRATNARVIEYQQKRDQIHERFATALNDNNLEEIRQIILDCEIVCPISGTRNWTEVRQFNLMFATEMGSTADGAMKVYLRPETAQGIFVNFLNVQKTGRMKIPFGICQIGKAFRNEIVARQFIFRMREFEQMEMQFFVRPGEELQWFEKWKNLRMQWHRALGFGDDKYRFHDHDKLAHYANAATDIEFEMPFGFKEVEGIHSRTDFDLSRHEEFSGKKLQYFDPEQNKSYVPYVVETSIGLDRMFLTILFGSYCEEETSNGEMRVVLKLPAALAPVKLAVLPLVRKDGLDAKAREIVHDLRFDFACQYDEKDSIGKRYRRQDAIGTPFCITVDHQSLEDNTVTIRYRDTMEQERVEISRLNAIISEYVSLKSLLKKIDL

SEQ ID NO: 241 - protein, 36 aa, Porphyromonas gingivalis
MVVLLFDLTKKAFLSEKSSHYHFLLEFGFHKGDYLE

SEQ ID NO: 242 - protein, 379 aa, Porphyromonas gingivalis
MKQILCTLDYELYGNGTGDVFEHIIKPTEELLAIARRHGIKYTIFFEVVEFWYLKREWERGNKMGYTEDPISAMEQQLREAYLQGHDVQLHLHPQWIGAVHQDGQWRLDLSNWCLGRYQGKGEYSLLSLLKRGKETIEEIIRPVDPHYSCIALRAGGYNAQPSEEIVRAMRQVGLKVDSSIYPGGFETGALSNYDYSSVAPDLGHWYVEDRLEYSAHGATDILELPIVAFPIRRLQKYLSLDRIKALFQNRKSAADTYSAKTANKGGIWGKISYFVELEWQTWDFCLFSKNLHRRFLKRVESQRGRKEFVLVGHPKSFVSGESFNYLIGQLKSSYQFLSMTELYDQRLKIGTKKGVKDTHKPETPAPEGPSPEGPEAGL

SEQ ID NO: 243 - protein, 308 aa, Porphyromonas gingivalis
MMKILPHVTNETAPLRTVVLGLPDSTGGAPALADTYDAKSYESVLRGTYPSDEDIKIEMDAVLDVLVRHGIEVLRPEPIANYNQIFARDVAFAIDDKLFVSNLIADRARESEAFSPIWDCVGESHLVRLSEDIHAEGGDILLYDDILFIGTYLQKDYPSFKTARTNARAVDFFREFFPHKTIIPIELIKHDTDPMRSVLHLDCAFQPVGRSRAIVYRQGFLHSESFGLITEIFGGRDNLFEITPEEAYMMNTNIFSISPDTVISEQNFVRLNNHLREAWGMTVEEVPYAEISKQGGLLRCSTMPLVRE

SEQ ID NO: 244 - protein, 192 aa, Porphyromonas gingivalis; identical to SEQ ID NO: 198

SEQ ID NO: 245 - protein, 1123 aa, Porphyromonas gingivalis
MASGHWVKIRVDASGVYRLTDEQLRANGFSDPSKVGVFGYGGGVLPEDLSRITTDDLPPVPVLRQGNALYFYAVGPVTWFYNPAKTTMEHTVNTYSTHGYYFLSDAAGAPLQMSQYTGGGASAEALIDYYDELMLHEQELYSPKESGRDLYGESFSAVNTRTVKFPLRGNTRSSGELGTVFSYIAKARSAGGGREMSLSANGILIFSDPFSMTSNEVSNSYLAGKKRRLYHSTPMNSLVNELRLDANYSMTGDAVNLDFIEVATQNDLRYDGAPMHIRRFSNLPVLGGESCRFVISEVPESLVVLQANSSLTASLVPVKTVGDKTIEFVAPPKGQDRRTINTFYAVDLSQASAPEILGAVPNQNLHGEEIPDLIIVSTQALLLEADRLATYRREKNGLKVLVVLQEQVFNEFSGGTPDATAYRLFAKMFYDRWKANAPVGETFPMQMLLFGDGAHDNRKVSVAWQKPYLQQTEFLLTFQAVNSTNVNSYVTDDYFGLLDDQPASVNIGWRNYNMAVGRFPVRTPAEARIAVDKTIRYEEDRESGAWRIRACFAADNGDKHATETSRLIDTVKRYAPAIMPVRAFQDVYPHVIENGLHSIPGAKKKMLETLQSGIILLNYAGHGGPAGWSDEHLLTLNDIHKFNYKHMPIWITATCDFANYDSQTTSAGEEVFLHEKSGTPIMFSTTRVVYNTQNEKINGFMLRRMFEKAKDGRYRTMGEIIRSAKQGMLSTVFPDSINQLSFFLMGDPSVRMNLPTHKVQLTAINGQDPEGQYGTIMLKSLERVALKGKVTDEKGTFDETFSGKVFLTVFDGRKKMTALEEEGNDLSLVYYDYPNVMYAGIAEVKDGLFETSFIVPKDVNYSEHEGRINLYAYNESTKAEAMGVDFSIRVQPGIPDEVTEDNTPPEIISCFLNDSTFRSGDEVNPTPLFMAEVFDLNGINITGSGVGHDITLCIDGRADLTYNLNAYFTSSATDAGVGTILFMIPALAEGDHTARLTVWDIFNNAVHHDFSFRVVDGIAPDVADVILFPNPVRESATFRIFHNRPGSDLNVAVEIYDFTGRLVNSLPVKTYSSSYGEPIEIKWDLTSKYGVKIGNGFYLYRCVVNSPGGQTASMAKKMIVVGQ

SEQ ID NO: 246 - protein, 292 aa, Porphyromonas gingivalis; identical to SEQ ID NO: 195

SEQ ID NO: 247 - protein, 639 aa, Porphyromonas gingivalis
CAGGCTTGGGATGCGAACTGAACAGCACGCACGGCTTCCCATCATCGTATGCGGCACCTGCGCCGACTACTATGAAGTGAAAGACATACTACGCATCGGTACCATCTCCAATATGTACCGGATCATGCAGCTTCAAGTAGCCACACGCCACATTATCTATCCTTGAGAAACTGCTCATCGAACAATTGGTATATCTTTGTTCGCGGACATTTTCCGTCCATGCGAACCCAATACCCTATGAATCGGGAGGAGAATGTCACATGAAGAAAAGAACAAGAACACTCACAAAAAAACGAATAACAGCTTATGTTACGAATTGGAAAAACGATCTTCGGACTCATAGCACTGACCATTCTCTTGGGATCATGCTGGTCCAAGAAGAACGACTTGGGTCATGACATCCCGTCTCAATTGGTTTGTCGCTTCACGGAAGGAGTACTTACCGAACCGGCAGATAACAGTATAAACGTAAGTCCAACAGCATTCTTCTCCAAAGATACCGTAAGTATTCACCACATGGTCTCCAATGCTTTTGGCTCTTTTGCAGCCCTACCCGGTAGCCAGAAACCAAAGCTTAAGAAGGGAATATGGTATAAAATGGAGATTTATCTTTTCGACAAGGAGAACAAACGACTAAAC

SEQ ID NO: 248 - protein, 192 aa, Porphyromonas gingivalis
MVMKKCLFLLVCVVVMATPLYAQRLIPGQKGMEITGSLPVINGEKLFRKDHFGVGISFTRYLKSENYTFLTAEYEQQNMAYRSYRVPMKDAFLQVGYMHPVLSDGGKNLFVCAGISALGGYEELDRGRTFLPDGARLLDRSGFVYGGAVHLSMELFLTDSLLLLVKAQGRLCFGSDVNLFRPALSAGFRINL

SEQ ID NO: 249 - protein, 304 aa, Porphyromonas gingivalis
MSRNQIYITQEQFDFFCQTQRPYEGFVEGVGYAFVHRGFVNPHANRPTNPFRQTKGYVLPFKQQLIEVSPDLIANSLKCNKTTDTPQEAPERDSRYLGERFYTKDGRYVYIGTMSGGWVCYDRSGNRILEQLPEIIVYSSKEPGRSIIGTGKDFVNAGLGIASTYMVYRGGYHKWNEAWHMTKTRGLRYRFQKQWKNPGAAHWRKVQTNTVRTARRTAGKLTKAGGALLVADIALSGELKPSHAINAVMLGASTTGVGTIVAGAWFILDFGTMGVNYLINGEAKSLSDIIDENIGTIEMYDGLY

SEQ ID NO: 250 - protein, 192 aa, Porphyromonas gingivalis; identical to SEQ ID NO: 198

SEQ ID NO: 251 - protein, 497 aa, Porphyromonas gingivalis
MARTSFQVGSEPLSLDLLREYLDSRFKLELSADAVRRIEHCRHYLDEKVKQSDKPIYGVTTGFGSLCNRTITPDQLTALQENLVKSHACSCGTPVHEDIVRLMLLLKAHALQLGHSGVQLCTVQRILDMLNNDVLPIVYDRGSLGASGDLAPLANLFLPLIGEGEVMYKGEKRNACDVMQEFGWKKIILKSKEGLALLNGTQFMSSHGVYALLKAHRLVEVADCIGALSLEAFDGLDAPFTDNLHIIRPHPGQLAVARHLKEVLKGSEQIARPKKQVQDPYSFRCMPQVHGASRDAIAYVTEVVIREINSVTDNPTVFPDEDLVVSGGNFHGQPLAIVYDFLAIALAELGNISERRTAQLILGLRNLPEFLVANPGLNSGFMIPQYAAAAMVSKNKMYCFSAASDSIVSSNGQEDHVSMGANAATKLLPIIENLEMIFAIELLDAAQAFEFRRPTKTSPFLEKMLGELRKVAPKVEDDVVMYKQIQAATEFVREYAF

SEQ ID NO: 252 - protein, 209 aa, Porphyromonas gingivalis
MILTDLTVKGFLAETAGQEPVPGGGSISALNGSIAAALAEMVANLTIGKKKYVEVEAEMQTIATEAAAIQKELVLDIDRDSDAYNKVFAAFKLPKETEEEKAVRSAQIQEMTKYAASVPMEVARRVHSLLPLIEAVVAKGNQNAITDGCVAMMCARTAIIGALLNVRINLTSIKDEDFVKTHTEEANAIEADAIRREAEILAITKKACE

SEQ ID NO: 253 - protein, 345 aa, Porphyromonas gingivalis
MSNAKRLLVSDMKMGVDISENELLRQSEGLLQRLLFDHTTQRNIFWATDDYTTLGDAYKYDAPITTDSITGEHDTVIQPRVLKSKEEQANRTKDKAEVFTPSWVCNAQNNLIDEAWFGRKDVFNIEQPETKTWIATTEPITFPEGKTWKDYVCSTRMEITCGEAPYLVSRYDTTTGEFIPIPQRIGMLDRKLRIISENTSSTGEWLKMAQKAYKNIYAYEWQGDNLLLAREALLITFIEYYEEKFGKRPLDKSIEYIAYIISWNVWQMDGLKGVVPNSCTHGVSVLPDDLFESMEELILCPGCQNESIKKHNGTYCLIRDWGCKDPKTGENNRKIRFVDLIKNNI

SEQ ID NO: 254 - protein, 1324 aa, Porphyromonas gingivalis
MATFESSLKPRLIYVFAIADARHEGSLKIGETTLNDDVGSASTEPNSEVLNKAAKARIDQYTKTAGIGYELLYTELTIYFSGGRVCSFNDKQVHSVLERSGVKRKSFAGATEWYSCDLATVKRAISAIKEGKDSLGASEVTLSDNPIILRPEQKEAIERTLKQFRKGNKMLWNAKMRFGKTLCALRVAKEMEAVRTIIITHRPVVDASWFEDFGKTFYDRPEWHYGSRSKGESFASLEKLASQGKKCVYFASMQDMRGSKDVGGKFDKNNEVFSTSWDLVIVDEAHEGTQTELGKAVLGQLMGKDTKALHLSGTPYNLFDQHKEEEVFTWDYVMEQQAKIDWEINHLGDTNPYASLPAIHIYTYDLGRLISEYSDEEKAFNFREFFRTREDGSFVHEGDIDRFLSLLCREDEEALYPYSNEHFRQIFRHTLWILPGVRAAKALSKKLSKHPIFGLFKVANVAGDGDDEEEESRDALELVNQAIGKDPDETYTITLSCGRLTTGVSIKPWTGVFMMAGSYSTSASGYMQTIFRVQTPYTHNGYMKTECYAFDFAPDRTLRVLAEAAKVSYKAGKQSESDRKLLGDFLNFCPIISIEGSRMKPYDVNTMLGQLKRAQIEKVVQDGFENGALYNDELLKLTEVELHDFDELKGIIGKTKAMAKSGDIDINHQGLTHEQYEEKERLEKRKKKGLTPEEKKRLDELKAKGDQRREAISILRGISIRMPLMLYGAEMKDEDKELTIDNFANLVDEQSWQEFMPRGVTKAVFRRFKRYYDPDIFREAGKRIREMARMADKFTIEERIGRIASIFSTFRNPDKETVLTPWRVVNMHLGDSIGGYCFMSEDFSTPIALPRYIEHQGITNEVFHPKSIILEINSKSGLYPLYAAYNIYRTRVEEAREKYGDVTRAFALQLWDRTLEENIFVVCKTPMARYITMRTLRGFRDVVTHTEHYPDLIENITSQPDSVVNMLRSGKRFWKINNDENMKIDAIIGNPPYQVMNQGKGNGSDPIYHKFFDLAMVLAPQGTLIHPARFLFNAGKTPKEWNEKMLSDKHYRVVDYWPNSAEVFPTVDVKGGIATSYWNKKMILGPIGMFSAFDELHHILYKVEQTNPLPFSNLVAPRELYRITDELYQEHPDLNGRQSAGHKYSFGANIFDVFPEVFFDEYPQGREEKMACIYGRANKQRCYKWCKRSYITHPENFAKYKVIIPKTNGSGAIGEVLSTPIIGTPIMGYTDTFISIGAFDTRNEAEACLRYVKTKFARTMLGILKATQDNPKETWRLVPLQDFTAESDIDWTQPVAEIDRQLYRKYGLNESEIAFVEEKVRPMD

SEQ ID NO: 255 - protein, 576 aa, Porphyromonas gingivalis; identical to SEQ ID NO: 185

SEQ ID NO: 256 - protein, 439 aa, Porphyromonas gingivalis; identical to SEQ ID NO: 196

SEQ ID NO: 257 - protein, 840 aa, Porphyromonas gingivalis; identical to SEQ ID NO: 197

SEQ ID NO: 258 - protein, 307 aa, Porphyromonas gingivalis
MIAKIIKGTSFSGVLAYILGKQEGKARILYADGVRANAQASDIANDFALQASMRPNVKKPVCHTILSFSAEDTERLSDKVMTDLAKEYLQRMGYADTQYLIVRHLDREHPHLHICINRVNNEGKTISDSNEKYCSTKVCKELTEANLLKWGEGKEAVKRHRLRGNDQLRYAIFDAIKAALPKCTNWQELTSELQKRGIEVQFKTKGQTEKVEGVIFSMDGVSFSGSHIDRSCSYSKLSFALEQNAKHALSLPALPKEDGFIEELSEAIEKLGENLFDSNAPAVDVAELIFQRKLRNQANKKLKRRRL

SEQ ID NO: 259 - protein, 197 aa, Porphyromonas gingivalis
MNKSLIILIYTLVWVLLIVLQSLALESANPGTPSFWNTPSAYYSVWIVDAYIIALYYINYFLIAPFMIKRHLFRPYIVLSLALGGIGMLLPVVFHHAWQWTVPGTSEGQMPLYGEGFIASIAAIAVGLSVRGVREWVRLARRNTNLEIALKNKSIAYDRAEARLRSLEQPVSFHNPGTGAKAENAPSSTPVSPQTNE

SEQ ID NO: 260 - protein, 513 aa, Porphyromonas gingivalis
MLKNHPKGLISASLTNMGERFGFYIMMGILLLFLQAKFGLSGKEASVIYSIFYASVYVLALVGGIIADSMKNYKGTILVGLIVMAAGYVMLGIPTPTQATGMTPWLIFTCAALAFISFGNGLFKGNLQALVGRMYDNDTYRDKRDSGFSLFYMFINVGAVFAPLVAVAIRNWWVQHNGFVYNADLPERCHQILNGTLPENAKAQVMEMIQAANNGTAVATEGLQEFALKYIQVFSTGFHYAFLAAVFFMAISFLIYIINKHQYPADQKANAVTEAHKDQKQEIKMAADEIRQRIIALCAVFGVVIFFWMSFHQNGVSLTQFAKDYIDLSSVKLDLGFTSIVGAEMFQSINPFFVVTLTPLLLFIFGFLKKRNMEPSTPKKIVIGMFIAALAFVVMAIGSMGLPTFEERNAGVEFTKVSPWLMVLTYMILTIAELFISPMGISFVSKVAPPHLQGIMQGLWLCATAVGNSLLFVGMILYESLSISATWIVFTCACALSMLVMLSMVKWLERVAK

SEQ ID NO: 261 - protein, 757 aa, Porphyromonas gingivalis; identical to SEQ ID NO: 226

SEQ ID NO: 262 - DNA, 839 bp, Porphyromonas gingivalis
  misc_feature (77)..(77): N = A, G, C or T
agacacagcttggatgaagaccgataagaacctaagccgtaagactgctttagtagattgttctaatagaactccanggattgaggagtgtttagaaaaggcgtattctgccgattcgtcattgggctttgcatatttgattaggcaaacaggtcaatgtatcatctttcggcggttttcaagatccatcggttcgttccgatgatctctttctttgcagcatccttgtcccgctcttatgtgacattttttagtaacgattatgcggacaaaaactatcttttttgcgattatctcttttattgctctattgtcgtcttctctgtcggctcagagcaaagccgttttaaccggtagtgtgtcggatgccgaaaccggagagcctcttgccggtgctcgaatcgaagtcaaacacaccaacatagtagccggtgccgatgccggcggacatttcgagatcaagaacctgccggcagggcagcatactattatatgttcgtagggggggtatggacagaaagaggaggtggttgccatcgaagccggacagaccaaaacgatctcttctgcattgcgactgcgaacgaacaacatggaggacgtcgtcgttaccggtaccggtacacgtaaacgcttggtcgatgctcctgtgagaacggaagtccttaccgataaggacatagatctgcggctcggaataccacaccgtacaaacgctgaggcgaatcgagccccacacaacacaatgatacccgtgccaacaagccaaagcaacgaatggtgagccacgatgaaaacacagaaacctggggcaaaacgattgaagaaaagagaaggac

SEQ ID NO: 263 - protein, 194 aa, Porphyromonas gingivalis
MNKQKNNRERTPQPEQDTERDEQLTNSHENDIDSAPAAEENDKVADPVEQLTAQLAALNDTHLRLMAEYDNYRKRTLKEKSELIRNGGEKVLVDLLPVIDDFERALSNLGDMSEPAAIKEGVELIYSKFMDYLQKQGVKKIETADLPFDADLCDAVAMIPAPSAEQKGKVIDCVKTGYTLNDKVIRHAHVVVGE

SEQ ID NO: 264 - protein, 497 aa, Porphyromonas gingivalis; identical to SEQ ID NO: 251

SEQ ID NO: 265 - protein, 209 aa, Porphyromonas gingivalis; identical to SEQ ID NO: 252

SEQ ID NO: 266 - protein, 576 aa, Porphyromonas gingivalis; identical to SEQ ID NO: 185

SEQ ID NO: 267 - protein, 576 aa, Porphyromonas gingivalis; identical to SEQ ID NO: 185

SEQ ID NO: 268 - protein, 429 aa, Porphyromonas gingivalis
MMTYEEAIRYLFTATPVFQHQGGSAYKPGLGTVETIDRVLGHPHKAYRTIHVAGTNGKGSTASTLAAILQVAGMRVGLFTSPHLVDFRERIRVNGICITEEYVVDFCERTREMVTTLHPSFFELTTMMAFDYFRHAQVDMALIEVGMGGRLDSTNIITPILSIITNIGKDHVQFLGDTPEKIAFEKAGIIKSGVPVVVGRAEGGVRHAFQHKADEERTDIVFAQESGVIISSTLENGCYTYQTRDYGSVRGELTGLAQEENARTILCAVEVLSKRCGLNLSSEHVREGFAHVTAMSGLFGRWQQLAEQPRIVCDTGHNEDGFRLITEQLRRQTYRQLRIVFGMVNDKDITAVLALLPREAVYYFTRASVDRALPEDDLRQQAAAFGLVGNTYSSVREALEAARREAHADDFIFVGGSNFIVADLLEEFK

SEQ ID NO: 269 - protein, 276 aa, Porphyromonas gingivalis
MKKTIAIIASALLALGAVGCKKNADTTAVSEKDSIALSMGILYGQDFANQFEMSRLQGQPIDSVAFLDGFKYGIDTTRFSYNLGAIYASNIARQLAHDSIDIDKFYAAMRAALLKDTVSIAMKPADAQAFMQRIQAKKQRENNMKQFGQNIEKGNEYIDTFKKEDGVTVTTSGLAYKTLQEGTGATPSLADTVRVKYVGTLVDGKEFDKNEEGIEFAVTGVIKGWTEMLQLMKVGQKVRVVIPQELAYGETGNYTIEPFSTLTFEMELIGIKPGKK

SEQ ID NO: 270 - protein, 253 aa, Porphyromonas gingivalis
MIIAGLAFLVAGLSAFAKKPPKKDEVQTVKPIVTSADSVAYAFGISGAINFNDYTGRMPGDSLDRALILRAFEEVLMGKSTAISSQNADEMIKKYFKEVQDRLKAENLAAGKAYQEEYRKQPGVKATESGLLYRVLKEGEGPRPTVQDTVVVHYVGKNIEGKEFDSSYSRNEPAKFSLLQVIPGWTEGVCLMQKGAKYEFVIPTELGYGERSMGELLKPNSTLFFEVELLEIKPFVEKPAKPIPAKPTPNKKN

SEQ ID NO: 271 - protein, 576 aa, Porphyromonas gingivalis; identical to SEQ ID NO: 185

SEQ ID NO: 272 - protein, 139 aa, Porphyromonas gingivalis
MDIQIQGQLIQILPLNSGVGKASGKEWKKQEYILETLDQYPRKIHFSVWGDRIDPSYQVGDQVTVWVDIESREFNGRWYTDVKAWRMERGYIGQQGQQQLPQEMPAAGAPTFPTQQPSMPSQPATGWASNADAGDDLPF

SEQ ID NO: 273 - protein, 139 aa, Porphyromonas gingivalis; identical to SEQ ID NO: 272

SEQ ID NO: 274 - protein, 367 aa, Porphyromonas gingivalis
MSLQCGIVGLPNVGKSTLFNCLSNAKAQSANFPFCTIDPNVGVITVPDERLNILADLCKPQRLIPTTVEIVDIAGLVKGASKGEGLGNKFLANIRETDAILHVLRCFDDDNITHVDGSVDPVRDKEIIDTELQLKDLETIESRIQKVQKQAQTGGDKQAKLAYQVLSKFKEALDEGRNARSVSFDTKDEQQIARELFLLTAKPVMYVCNVDEASALSGNKYVEAVREAVKNEDAEILVVAAKIESEIAELETYEERQMFLEEIGLKESGVSRLIKAAYHLLNLQTYFTAGSDEVRAWTFLRGSKAPQCAGIIHTDFEKGFIRAEVIKYNDFVSLGSEQAVKEAGKMSVEGKEYVVQDGDIMHFRFNV

SEQ ID NO: 275 - protein, 367 aa, Porphyromonas gingivalis; identical to SEQ ID NO: 274

SEQ ID NO: 276 - protein, 576 aa, Porphyromonas gingivalis; identical to SEQ ID NO: 185

SEQ ID NO: 277 - protein, 424 aa, Porphyromonas gingivalis
MFDLDNLHELGATLRKNMLRTALTGFAVAWGVLLLILLLSAGRGFQHGIRHNVEQFGMGTSAISFSTWRTSKEYGGYPKDRYIELTPADCDYLVKLNPDLIKGAAYYTNQWSYDVQYEDRTHSTPTKAVSGEYGNMVKTHLIEGRFLSTSDDAMKRKVIVLCEQTADVLFGESISPIGKYVNLSQIPFLVVGVCKGEQGQFSPNYIPFATYSGIFAKGFSLDCTLFMNCPSVRTEENVERLKVLLNRQLAFRKGYDPTDMEVPYVDAPVTDIKMMDKIFNGMDVFLWIIGLSTLVIGIIGVANIMQVTVNERQREIGIRKALGAKPRAIINMILTEAVVVTLFSGLIGLVAGVGLMEFVSHWVQTTGVGSRQVEGITLTLFRDPSIDLSTALLALIVMVVSGAIAGYQPARKAVRIPAVEAMRN

SEQ ID NO: 278 - protein, 367 aa, Porphyromonas gingivalis; identical to SEQ ID NO: 274

SEQ ID NO: 279 - protein, 490 aa, Porphyromonas gingivalis
MKQSRYIILSFLFGMSTLAVTGQTHLGGIKVSEKHVVKKTGHTANVKMDLDLTAIPDMNSNLLMVVTPIIRSNTSNDQVALRPFLLMGNRRYRIIDRRIALDKHHIYNQPDTKPSAMVKRRNGKEQSMDYSAATPYRPWMRHSSMILLAENSGCADCPLGSEETTLTDDALVPLYEADYQYEIIVPEGELLKKREETLSAHLAYQVGKYVVLPQFDGNPAELARIDSKLKEIGNDSDIIFEKLSMVGYASPEGGVEYNAKLSKDRAHSFASYLVNKYPILKSRFEYDWKGQDWAGLRAAVTKSGLSQKDAILEIIDQKPVGERTAALRAIDGGSLYATLLSDYYPPLRRSELTFHIVVKGFELDKAREIIKTHPSRLSLAEVYAVAQSYPEGSHERYETWTIAEKTFPKAIEPTANAAIIDLRAGRYPQALARLEARKSEPKLWMLLGLAYAYSEKWAEAESYLTRAAQQGRPGAQHNLNELRRYMQDNL

SEQ ID NO: 280 - protein, 265 aa, Porphyromonas gingivalis
MKIMNVILASVLVVLLAGCSTVPISGRSQIMLVQDSEILSSSALQYKQFLSKVKISKNATSTAQVRRVGQKVAAATMLYLKQNGLGDMASQMKWEFNVVEDKAVNAFCMPGGKIVVYTGLLKLVGSDAELATVISHEVSHAVARHSNERISQEYLRQMGGNILGAAVSNKSAALQTVIGQAYGIGSQVLITLPYNRKQEYEADKIGLVFMAMAGYNPNAAITFWQKMAAQGNGRVEFLSTHPSDANRIAAIRQYMPEAMKHYKSK

SEQ ID NO: 281 - protein, 576 aa, Porphyromonas gingivalis; identical to SEQ ID NO: 185

SEQ ID NO: 282 - protein, 528 aa, Porphyromonas gingivalis
MATTKSRTKRPAPESITAPLEGRVPPQAPELEEAVLGAILLEKDAYMQVGEMLRPSTFYLKTHELIYEAITQLALNQKPVDMLTVTEQLKKNGNLDAVGGPSYIAGLTLKVASSANLEFHAKILAQKALSREVIGFSSEVLKKAYDDTEDIEDQLQQAEGRLFEISQHNMKQDVQPIDPIIKEALGEIQIAANRKEGLSGQPSGFPAIDKLTAGWQASDLIIIAARPAMGKTAFVLSMAKNMAIDYNIPVAIFNLEMSSVQLVKRLMSNVCEIPGEKLKTGRLESHEWVQLDTKLKDFENKPLYIDDTPSLSVFELRTKSRRLVREYGVKVIIIDYLQLMNASGMSFGNREQEVSTISRSLKVLAKELKIPIIALSQLNRSVETRQGDINSKRPQLSDLRESGAIEQDADMVCFIHRPEYYKITEDQQGNSLLGIGEFIIAKHRNGPVDDVRLRFRSEFAKFLPLEAESMVKRHSRIGGSPVEMGVGNGSFAPPLPPPEDNPLLSGPYSSGTSEADFLAEASGIDNPF

SEQ ID NO: 283 - protein, 647 aa, Porphyromonas gingivalis
MRYGFMKVAAAVPFVKVADCEYNIERIDRMVHEADAKGVEIMTFPELSITGYSCGDLFFQPFLQERANEALCRLVEQTANTTVMVIVGMPLRVEEKLFNSAVVFQQGKILGAIPKTYLPNYREFQEARWFSPAHTLQYSTISIGQHSVPIGRNLIFKCGTVGVGIEICEDMWTPFTPGTRLCLYGAEVIFNLSSSNENAGKHSYLRSLISGLSSQGICAYVYASSGYGESSTDIVFTGKAFIAEAGEIVEEMERFRYEERMIISDIDVSRIQTERLINSSFKAAVTFHTHDEKFNQLPFKLRSRQESLPMTRRVDRNPFMPEDKDRKERSREMINIQVCGLMQRLLHMGAEHAVIGISGGLDSALALIVCAQAFDRLDLPRKNIIAVTMPGFGTSDRTYRNAFALMEAIGVTIKEIDIKEACLRHFEAIGHNPEVQDTTFENTQARERTQILMNLANIYNAPVIGTGDLSELALGWVTYNGDHMSMYAVNAGIAKTTVQILVDHIAHSGWLDEAASAVLLDIVRTPISPELKPVGQDGNISQKTEDLVGPYELHDFFIYHFLHNEYKPSKIYYLAGVAFKGIYTKAEIKKWMMVFFRRFFAQQYKRNCMPDGPKVSCISLSPRGAWRMASDASSALWLDEIAKFETD

SEQ ID NO: 284 - protein, 351 aa, Porphyromonas gingivalis
MKRNTRLLFVVPAFFAIFAMACACQGGTAGKSFTNSTGSPGEMMLVMDDQYLGSPVGEAIYEAMTEVAPALNQNEPIMAVSRVSEKDFTGFLRYIRNVLQIDINPDIFTKTSLKYGYDQWANGQLVVLINSPATDSLTAYVESNKSAIQNLFIRHELFLFGQLWQKDCSADADQRVQRMFGYHINVPADILSHKEGKDFLWMSNNQMRRRKDFLVYTFPYRGASDLGLDRMVEVRDSVLKANIEGSDAGSYPVTERMLLKHRYVYPGDQKRGEVHGIWRMEGGQMMSGPFVAQAFVDGDRVVVVEGFVYHPNEKKRDLMRQMEAALYSMRPKAEKEFDPSIIRKARWTTLK

SEQ ID NO: 285 - protein, 333 aa, Porphyromonas gingivalis
MKKYLLYASLLTSVLLFSCSKNNPNEPVEDRSIEISIRVDDFTKTGEAVRYERNQGSAAERLITNLYLLLFDQSGANPAKYYITGNTFTGGTWLPDDMKVKLDMTQSEAGERKVYVVANVDNAVKTALDAVANESDLQTVKRTTAMPWSTDIASPFLMSGNKTHDFLANRLLDNVPLVRAIAKVELNISLSEKFQIVPIIVNGSLSEFKFRYVNFDKETYVVKPTTKPDNLISSANGVWPQITDWTVWGASLNTSPAPDAGTGYTLDANGKVTALRIVTYLNERDSKGATVEVALPRVDDGTLPPPEFGPELYRLPLPDKILRNHWYKYEVEI

SEQ ID NO: 286 - protein, 833 aa, Porphyromonas gingivalis
MKQLNIISFIIAFLFLGTSASAQQSGGSVTGTVVDKSSKEPIAYVQVFVKGTTLGTSTDANGNYSIKGIPSGNQTIVARLMGYSTCEEKVHIEKGGSRHVDLYLTEEILSLDGVVVSANRNETFRRQAPSLVTVLSPELFLKTNSTNLSQGLKFQPGLRVEDNCQNCGFNQVRINGLEGAYSQILIDSHPIFSSLAGVYGLEQMPANMIERVEVIRGGGSALFGSNAVGGVINVITKEPLRNSAEISHSTMTFDHAKGWGSFQNTTQFNGSMLTEDRKAGVMVFGQHNYRPGQDIDGDNFTELPNLRNRSLGFRSYYKTGLYSKATLEYHSMQEYRRGGDRLDNPPFEAQIAEYLQHYINGGSFKFDQGFSGGKDFFSLYASAQDVQRRSYYGGGDYTENLLNGAVQSGSTESDEYNDAFTALTSYGTTKGFDLQGGGMYRHTFGENWDFTGGLEYIYGQLDDRSGYRPSKIDQNTSTFSQYDQLEYKTEKLSALIGARIDYVLLNQDGKRYIDPLFIFSPRANVRYNPNKNLSFRLSYSEGFRAPQYFDEDLHVELAGGTPISRVLSPNLKEERSRSISASFDYYHRADEWQFNIMGEAFSTFISNQFKPSDKVETTSDGKEWIIRTIYNDKDGVSKVYGVNLEGRIAYNKSFDLQLGGTWQRSRYGSIYTAVEADKTTGQAEISVKDYVRTPNLYGYFVATVRPTEHFAINLSGTFTGKMDVVHEAYEGDIPAEHIAPDGSFDFEMNGQQFKGLAEGHAKLVKTPAFADIDLKLSHDFHLASTMTLELNAGIQNIFNSYQKDTDKGPGRASTYVYGPMQPRRIFVGTKINF

SEQ ID NO: 287 - protein, 307 aa, Porphyromonas gingivalis; identical to SEQ ID NO: 258

SEQ ID NO: 288 - protein, 376 aa, Porphyromonas gingivalis
MYHSLFESLCMVPDPRIERKKIYPLDFLLLIVFLSTLSGNTSWYEIEDYAEEYEEELKSLYEMLTGHQLMHTMPSHDTLNRSISLLDVEAFEGAYKRWIEGFISATSGKHICIDGKTMRGVKKLSFDTQSHVVSAFSPQDMCSLAQLYIDRKTNEIPAIHQLLDLLDLNGAVVSIDAIGTQTAIAEQIIDKGGNYVLCVKANQSLSLQEIEAYFCPLFQKHILLDEQTELSHGRIETRRYESILNPLEIEANEVLTRWKGLRSIHKVVRKRRDKKSDKTSEEVAYYISSLTDVSSLKQAIRGHWAIENKLHHCLDVYFGHDASHKRTRNVAQIMDIIQKINLLIIERLKTNMKSSIPRIQKKLARMKPQQLITIQF

SEQ ID NO: 289 - protein, 675 aa, Porphyromonas gingivalis
MIVCIAEKPSVGREIAAVLGATKAYKGYMEGNGYQVTWTFGHLCALKEPHDYAPEWKRWSISSLPMIPLRFGIKLIDSDSIREQFGTIERLVHEADMVVNCGDAGQEGELIQRWVLQKTGCTCPVRRLWISSLTEESIREGFARLRDSEEFHSLYEAGLARAIGDWLLGMNATRLYTLRFGGNRQVLSIGRVQTPTLALIVRRQHEIEHFTPEVYWEVKTIYRDTVFNATKGRFSSIEDARREVEVVAGSPFAVTSVATKKGRELPPRLFDLTGLQVECNKRFAMTADATLRTIQSLYEKKITTYPRVDTTYLSDDVFEKVPNILQGLSDYTLLTAPLRSSKLKKSKKVFDNSKITDHHAIIPTGQPSHGMSEDERRVFDLVARRFIAVFYPDCIFSQTTVLGQAAKVEFKTTGKQILEPGWRTVFTDPQTDDDGENKDEEKKLPIFSEGESGVHTPEVQEKTTQPPKFYTEATLLRAMETAGKSVKDEELRDALKENGIGRPSTRAAIIETLFKRNYIYKEKKNLKATPTGMSLIATIDYDLLKSAELTGQWEYKLRRIERGDYSAADFINELKVLLTHLIPNVLKSNSSVLLSEPIPAASPAPGKKKKADKPMQKQLDLTCPVCGKGIIVRGREAFGCNAFREGCTFRLPYSEYPASLSDNELVDLLSSQKGH

SEQ ID NO: 290 - protein, 196 aa, Porphyromonas gingivalis
MIMEKKNKPIRLLAALLPIIAGLVLVTWRPASGSVPARTAINNHYTTPTPADTTRFPVKKTQAKDYRYLGGNYPLDLKTPDNIRTEFIYDEKTNTYLLVTKLGDKPLGSPIPFTPEEYLRYMQRDSIRRYFMEKERLEAQQEGKKRFNPLEMSFDLGPAEKLFGPGGVKLRTQGSAEVAMGAKSNATNNPSARKCT

SEQ ID NO: 291 - protein, 202 aa, Porphyromonas gingivalis
MIEYLKGAIVGLTPTNLVIECAGVGYDVNVSLTTYSAYQGKKEGLIWITQLIREDAHLLYGFSTKEERTLFGQLTSVSGVGPTTAQLILSSYAPQELAALITTGQADALKAVKGIGLKTAQRIIVDLKGKIQLETSSDEILSARTAVGDAALNTIASGEEAISALKMLGFADPAIRKAVKSILSEDSSLAVEDIIKRALRML

SEQ ID NO: 292 - protein, 1515 aa, Porphyromonas gingivalis
MPLESKVVCVSQRKKLSAGLIRFIRRYRKAMRRSKWIVVAVLTVAFCLLILPNLILQIPSVKRSVAGRVQTELSKALGTHVRIGHISIGWWRQMEIDDIVIFDRARRPAVSAERLTGGLDLLPLLKGRLSFSSARLFKGELDVYRSRPDTALNIQFLLDALKSKNPEEPSRLRLNINTILLRNCRLSASGLYKTQSDTLGLLDLNAKVRLFQADSTGLKAQLRHLSFLEKNTGLDLKELHADVSLRGDTLGVARLHISLPNSHIGMVSGYCVLSPENSALPAIRVTDLGGRIRPSDLKGLLPALDTMDDILNLSVPELTVASGEAVLPEISMNYGDELTLQAGIGLAEIGKKERMHVRLRLDELKLGVRTYMLAERLFPDKLPTQMRHLGAIDIMAAANGRLDDLRLKTRVETDAGALTIQGSIGLDSLWRLADVDAHATTERLELKLMADRHDWPEHVAFDLKMKARLAAGNLLSGSVEGRVSHLTFRGYTYEDLTIDLQADKGQWSGILNMNDPNGHIRLSSAGEGLPFSSSSSRFEWNLTAHKLRPDRLLPGFGLPSADALLISSGELVGSRIDDLTGTIRIDTLDWQTSDKELHLHNVKLAMARVERHSSITLSSPFLEGALHGEFTLSKLPSMLEGVVGAHLPALAGHRSQARVPTEDVRLRLALDGSLPKEVCSFFRLPLAEADSIRIRAAYSELLRSLDLHIRTDRLMTMNKELRDTEVTLNSSTGKAELICRSDLYVNGDATTRDLNLKASVANDSIRARLDMGQDKRGAKNGFISLLTNFHRDEDSSLNTHIRLDRSTARIGRYEWQIASAEAMLAPERVVISDLSIKSEGKAIEAEGVLSSSPSDSLRVRVDHISLKYILDLAGVDFDMLDVEMTGEAVLSDIADRQFMQARITGESFTVNGIDVGPISAFGSWEKSTQRILLDASVHNPDGTSTSAWGYIRPFNPHAGLDLRFDAKHADVAFIGPFLSEFCHKLEGHASGNMRLFGDFSDLTIEGEVMAEHVTFGVKALNTEYKCDGQKAVFTPTRMRFENMLVSDPDGHTARLNAHISHRAFDDIKVDLKVSEARNILAYNVPERDNPNIHGRVYVSGAAYLRDVPGGMRCDVNLISEKGTHIVLNFTQPTTAEEYRFLRFVDPKSSRERARQETSPDRPSLLLPATGGDPETDFHLVMNVGVTPDAEVDLILDPQTGDGLRGSAGGDLRIDYHTLGDLNVFGGLELLSGTYNFNLRQIVQKRFSIKEGSSVNFAGNPMHATLNVTAEYNLTANLNDLDESLVSDVRRTTIPVNCLLQINGAMLQPAVSFDIKLPNSDSELERRVRSLIHSEDSMTKQIVYLLVLGKFYTPENVYNSGSGTDNWTAVATTTLSQQLTNMLGSLSDKVQIGTSIKTTNTSFQDTDIELLLSSRLLNNRLLINGNVGYRDNPNLQNTYVGEFDAEYKINPSGSIRIKAYNHYNNLYQYLRQSLTTQGLGLIFKYDFDGRRLRTKRAGEARSGIDSLTRPDSVRAQ

SEQ ID NO: 293 - protein, 891 aa, Porphyromonas gingivalis
MAKPVVETPLMRQYFQIKQKHPDAILLFRVGDFYETFSEDAIVASEILGITLTRRANGAAQFVELAGFPHHALDTYLPKLVRAGKRVAICDQLEDPKKTKTLVKRGITELVTPGVSTNDNVLSHKENNFLAAVSCGKEVFGISLLDISTGEFMAGQGNADYVEKLLTNYRPKEILVERSERSRFNDLFHWSGFIFDMEDWAFSSENNRLRVLKHFDLKSLKGFGLEELSMAVTAAGAVLNYLDLTQHHQLQHITSLSRLDENRYVRLDKFTVRSLELLSPMNEGGKSLLDIIDHTITPMGARRIRQWIVFPLKDPARIQARQRVVEFFFRHPEERAIIAEHLTEIGDLERLVTKGAMGRISPREMVQLRVALQALEPIKEVCTHADEENLRTLGGKLELCKELRDKILREVMPDAPAALGRGPVIAHGVDATLDELRALAYSGKDYLIKLQQQEIERTGIPSLKVAYNNVFGYYIEVRNTHKDKVPAEWIRKQTLVSAERYITEELKEYEAKILGAEEKIAALEGQLYALLVAELQRYVAPLQQDSQAVASLDCLLSFAESARRYRFICPVVDESFTIDIKAGRHPVIEQQLPADEPYIANDIYLDTDRQQVIIVTGPNMSGKSALLRQTALISLMAQIGSFVPAESARIGMVDSIFTRVGASDNISMGESTFMVEMQEASNILNNLTPRSLVLFDELGRGTSTYDGISIAWSIVEYIHDNPKAHPRTLFATHYHELNELEGQLDRVHNFNVSAREVDGKMLFLRKLEPGGSAHSFGIQVARLGGMPHHIVQRATDILHRLEQEREKIEEEEPKTKDTKRGPSEKVKNASPTLPRDEKGRSIDGYQLSFFQLDDPVLSQIREEILDLNIDNLTPLEALNKLNDIKRILRGY

SEQ ID NO: 294 - protein, 576 aa, Porphyromonas gingivalis; identical to SEQ ID NO: 185

SEQ ID NO: 295 - protein, 307 aa, Porphyromonas gingivalis; identical to SEQ ID NO: 258

SEQ ID NO: 296 - protein, 403 aa, Porphyromonas gingivalis
MIRKGAIGRLLSRYREEAVLCCILSLLYGALTMHIASTGLLTPHDGLIGAYLGYDNYYRFETAGGVFDISHPFLNLFYVLNRFGFVTIGGESLALGICLTLMTLCTAAGVTATYAYLRRVAGQGRTRSLLVTLLSAGSFTALTLPFTIESYPLSFFLLPLSITVLSVRYKMRGSFGGVTIRWFAFLLGGITLTNVAKPALAFLLEKGTIGSRIRKGAALAGAFSLTVLLIGLLFTYRAAKQGQPENDPRTLAIRMFDFRQGADESVAEYFGHPLLISDLAPARRYEETTLRPTPYRRPWSYIVPLLFLSTVVAAPLLRRREKLVWLLLLYLSVDIGVNVIGGYGMNEAVIFGGHWVFLWPMLLGWIYRSIPRKAYRPMDMAVFLFAAVQTVHNLSVILLRLHL

SEQ ID NO: 297 - protein, 367 aa, Porphyromonas gingivalis; identical to SEQ ID NO: 274

SEQ ID NO: 298 - protein, 139 aa, Porphyromonas gingivalis; identical to SEQ ID NO: 272

SEQ ID NO: 299 - protein, 480 aa, Porphyromonas gingivalis
MEFELEQHTPIIHFQARDAGATLRASEVKPKLDKFILTQIGKRFVKKTASTTEKNFIERGIEYFQNKDEEARRVYEEEKKKGNKGAKLELCLIPGQEGALNYKLSFKLSPDAKVQYFLPMSSNPKEIDKLKSLAQEKLGVQEVEMLPLTSYFANEDKAKSEPNIKHGDTPDQIKNKKRIFEENWQKVQLATFVNTPVEGVIRFQNAGLREEVNNLITNFFMLHNFGARQSKGFGSFIISLRDGKEEEDYFDTGCACYGYSFYIPAKTLEEALRKINYFYRSLRSGFNEYRGKNEIFYAKSGMHFYATKHNFEWDKKSIKGMLFDRDKDLEGKMKKEELFAFRDLLGLSSNERWQSYKTTITKECRNKKGEKFDRIKSPIQFKPICYSKYDYIVFFDLFPEKSGIPQLKGGKVVVKSSRHKGAVLELKIQEDIDLYNVFNEIFSELNFESQVGEYDSLTDAKEIFETMKDIYEQLNKNCHE

SEQ ID NO: 300 - protein, 72 aa, Porphyromonas gingivalis
MVVATATIIVVAIIWSYKLKIKKEELRDKTLFELERERTKDLNKWQSFSESLLETNKGLMEVYCKDNTKQKA

SEQ ID NO: 301 - protein, 46 aa, Porphyromonas gingivalis
MAVATTTKQSKIKVSISMLFSVFEIMSYWEVEADGKYYKRNNIATQ

SEQ ID NO: 302 - protein, 490 aa, Porphyromonas gingivalis; identical to SEQ ID NO: 279

SEQ ID NO: 303 - protein, 668 aa, Porphyromonas gingivalis
MKPLLTVVCAIILLSLPLGGQTVVPEWDEYIAEQIESGALGEDEGAEFLERWMVQKQHPLDINTLTREDLEQFPFLNEFQIRRFLLYRHAHPEGFDSIWVLSEIAGWDRRTCLLLWPMLTVQKRSESAAASFREILSYARHDVSVHTDAILQQQEGYRPDSRHPYRGDPWGGGLRWSYAMGNRFSLGLTASKDRGEPAFDKRRKGFDSYSAHFFMEGKGAVRAVALGDYRIGMGYGLLVNQASFMGMAYAYPRGGTTLRRAFTYAEDNFMRGAATALAQGRWALTAFYSRQGIDATVTEDGAIKAIYHTGLHRTDAEIARRNAATMTTAGTSVCYTDDRLRLTFNLLHLHWGGLRLLRAVGTQGIASLTDLERFSLVSADYSYLFGQGGTELFGEFAGAANGAVGTINGLRYTHPVGGSYMLVGRYIPADYWSYYRGAFARYSRPGNEWGVMGRAAWELPSDRTVRAFADYYGSFVPRFGRKEKTEALYWMFEGEKRLSALSWSCRIRGTADKRYRRSLAVRLRGRYMFDERWRLMASLQWSRSNSFDRELQTWQAPTGGKSFALRADYSGGKLLRVCSMDAVAFDTDSFADRLYEAVHNPRHHYSSAFFYGRGVRLGVFVRIAPLPQVEVESRIDHLLRRDTDTIGSAGELIRGQARTHLFMTVRYR

SEQ ID NO: 304 - protein, 265 aa, Porphyromonas gingivalis; identical to SEQ ID NO: 280

SEQ ID NO: 305 - protein, 501 aa, Porphyromonas gingivalis
MTDHVFRIKGLYILLITCVLMSVVSASGQTRSRTKVHVVQAKETVYGLARQYGLSEDDIYTLNPSARQGIKEGQTLLIPSKPVRANSKISAARHPSEHIIRPQETLYSISRKYGLSEEELMKANPGISATNFPAGHKLRIPGSDSTAMASSPTTSQSEAIEVGLMLPLSGNTQRYVEFYEGMLMGLNRLKKRGVSVTLRVYDVSNTSDAEDVIHSGELNDCHLIIGGASNDQIAAISRYADRRGINYVVPFSSGKIAGKASANLFQINPPQEYLYPQVAKLFMQRYADRTAVFITGAGETEPCAAFIMSEMDKAGRPYTKISSDREQGELVKLLRSDTRIVIMPCMTGESILRRMLSLADGNGKAELVTFFGYPEWQSFDRDLQGRMRKYGSSFYSSFFFNPAQPESEQFLSQYYAWYNHKVSGGFPKYSVLGYDITNYFIGGLASYGRSLRNNLSMLPSTGLQTDFQFREIRGDSGFVNLNLFLVTLRSDGGVDRVPVSR

SEQ ID NO: 306 - protein, 60 aa, Porphyromonas gingivalis
MTHRLLRYSIAASGIQKHIAYCCFHHTFAILQLAASTDIYTDSKMLTRKNAPQPKSIATD

SEQ ID NO: 307 - protein, 548 aa, Porphyromonas gingivalis
MATPEFKYQKPFPMGDDTTEYYLLTKEYVSVDKFGDHDVLKVEPEALRLLARTAFHDIAFYLRPEHQQQVARILSDPEASENDKFVALTFLRNAEVSAKGQLPFCQDTGTAIILGKKGQQVWTGGHDEEQLSHGVYDTYTQENLRYSQNAPLDMYKEVNTGCNLPAQIDLMAVDGMEYDFLCIAKGGGSANKTYLYQETKALLNPKTLVNFLVDKMSSLGTAACPPYHIAFVIGGTSAETNLKTVKLASAKYYDNLPTSGNEGGRAFRDVELEKEVLEAAYHLGLGAQFGGKYFAHDVRIIRLPRHGASCPVGMGVSCSADRNIKAKINKDGIWIEKMETNPTRLIPESMREGTEGTVVKVDLNRPMPEILRELSQYPVSTRLSLSGTIIVGRDIAHAKLKERIDRGEGLPDYIKNHPIYYAGPAKTPKGMPSGSFGPTTAGRMDSYVDLFQSHGGSMVMIAKGNRSQQVTDACKKYGGFYLGSVGGPAAILAQDSIKKVECLEYPELGMEAIWKIEVEDFPAFILVDDKGNDFFTQIREKCKGCALH

SEQ ID NO: 308 - protein, 662 aa, Porphyromonas gingivalis
MSPTIYYILCVLLSLMVLGGISMMSRVKTAVMGNTLSAVAMLGGIILTLVYNEILPAWSVYIFLIIGAGIGWTMAQRVKMIQMPQMVALLNGVGGAASALVGILSLAAIGINPNNNTAADYPIFSQATGMLALTVGMITLIGSLIAAGKLHKLLPQRPVIWPNHSMFTSLLLILTVGFVVLGSVSIEGFPLFWAIIGGLFFSSLFGLFFSIRVGGADMPITISLLNSLSGVAGAIAGMAVGDILLVAVGGIVGASGLLLTQIMCRAMNRKLMSILMASGAKATPAATTPTTASKQEKGEVAAPAPAKAEKTAGSVLRDAKRVIIVPGYGMALAQAQHQVRQLADKLTANGTEVRYAIHPVAGRMPGHMNVLLCEADVPYDQLFEMDAINGDFAQTDAVVVIGANDVMNPAARNAEGTPIYGMPVLNVDDAPEVIICNFDLKPGYAGVDNPLYTRATGVFLKLGDAKESLAEIMKEMDATGDTAATAAPAKAEKTAGSVLRDAKRVIIVPGYGMALAQAQHQVRQLADKLTANGTEVRYAIHPVAGRMPGHMNVLLCEADVPYDQLFEMDAINGDFAQTDAVVVIGANDVMNPAARNAEGTPIYGMPVLNVDDAPEVIICNFDLKPGYAGVDNPLYTRATGVFLKLGDAKESLAEIMKEMDIA

SEQ ID NO: 309 - protein, 1160 aa, Porphyromonas gingivalis
MRSHRFLYLLVFYLLIPVAVVFGMLSCSTSKNTAASRFYHNFTTRYNVFYNGQNAYNDAYDRLLESHTEGYSEEIFLDPITAQSGQEKAKEGGAFDQAIVKGRKAIHLHSIRTKPERKQGWQSDPKAVAFQNKREYNRFLHNAWMLVGKSQFYNADFLQAQATFSYIARLYSDEPIIRDEARLWQVRCYSEMGWLHEGERLLERIPKDLPHVDRRGLYSLAVAERSILSGDKRAAIPYLQQAARQEKNKRQRARMYYLLGQLLQENNRPEEARKAYSKVLRASPPFALDFAARIRKMELEGERNPRTVAARLERMAKKGKYKDVLDQIFYAAGNIYMDIPDTLAAIKTYTTGIEKSTARGADFALCQIRLGDIYMQRKQYLKAQPCFSAAAGVLNRLNPDYKRVAELSSRLDELVGHAKVVHEQDSLLALAAMPEEQRLAIIDSVINAYAIAEKKRLEEEEMAKLQQSQELFNAESEGFAPSAGGKTQNPPPGMQMGGASGEFYFYNPQLIAQGKAAFERKWGKRVLEDDWRRRRKQANFDIPTDDSSTAEETDETQPGTLMTEEELQAAAADSATSNPLNREYYLAQLPMTEDAKEAAGKLIAEGLLGMGAVFNERMEKFDESADTYETLLRRYPNYEKKMDVLYRLFMLYTRMNNKPEAERCRALILQYYPEDNLAKALSNPDYLKELAAMDRRQNELYGQAFDSYLKGVVGSVRKSRNECRERFPLSELAPKFDFLNALCYVLESDSKGFTSALKQLVKDYPKADVTELASSMLTELLRGRSIVQGGYTGIDWDIRWGSSDTDSISPDSLPPFVKPKSFERTRLILLAPAGTLNKNRVLFALASFNFSRYTEQTLEIVQSTVGAFDQWLMTSLPTPRMGWQYIKDAFAPNGFMSAMGESSLLFPISESNYQLLVKGKSIGQYMTFLAKEEVPETAFVLDRWQQMTGRAQAVGKEDEDIEPAGTPAPIVSDKNEAEDTARDSTSGTDRKPLVSIKPHKDSIMTATPITFDIDREQILSGAKPVAADSSAADTISDAAALPSLKQQEGKDVSVEQIQRLAKERAQNEKDEKKALEKAKREKERDRKRELKAREKEREKARRDKLKDQRLKQKEREQKLKEKERERKEKLRQRERERKARAKEREQKKKAGQNKSGGGPQ

SEQ ID NO: 310 - protein, 336 aa, Porphyromonas gingivalis
MDLIQDVIRRAQENKQRIVLPEGLEPRTLEAADRLMADKVVNIILIGNVDSVKAKVAELGLKNLAEAVIIDPNNHPKKQQYTDLLLQIRQKKGLTPEKAAELVENPLYLGCLIVKSGDADGLIAGAQNTTGDVLRPALQVIKTAPGMTSVSGTFLLFTKAKEYGKDGLLLVADCAVIPNPTADELAQIAVATARTAKAIADIEPRVAMLSFSTKGSAKHEMTDKVVEATRMAQEMAPDLLIDGEMQADAALVERVAALKAPGSNVAGKANVLVFPTLEVGNIAYKLVERLGHAEAVGPILQGMAAPVNDLSRGCSVEDIYRMVAITANQAIAAKEQ

SEQ ID NO: 311 - protein, 398 aa, Porphyromonas gingivalis
MKVLVLNCGSSSVKYKLLEMPKGDVLAQGGVEKLGLPGSFLKLTMPNGEKVVLEKDMPEHTIAVEFILSVLKDDKYGCIKSYEEIDAVGHRLVHGGEKFSNSVEITPEVIAKVEECIPLAPLHNPANLKGVVAIEKLLPGIRQVGVFDTAFFQTMPEHVYRYALPYDMCNKHGVRRYGFHGTSHRYVSARACEILGLDYDKTRIITAHIGNGASIAAIKNGKALDVSLGMTPVEGLMMGTRSGDVDPGVLTFLMEAEGLEAAGISELINKKSGVLGVSGVSSDMREIEDAIKNGNERATLAMTMYDYRIKKYVGAYAAAMGGVDVLVFTGGVGENQYTTREKVCTDMEFMGIVFDSKVNEGMRGKEMVISKPESKVTVIVVPTDEEYMIASDTMTILK

SEQ ID NO: 312 - protein, 301 aa, Porphyromonas gingivalis
MTSSRLYGLAVGILSSATFGLIPLFTLPVSAKGASFELILFYRFFFAAIAIGILHRLSGGSFKVSRADIGPLVLLGFLYAGTALFLFHGYGYMASGVATTIHFLYPLFVTALMLLFFGERLSPVPLTAIFIALIGVGLLMGLTGGGDRVGLTGFVIVAISALCYALYIVFVNRSRIRIMPGRRLTFYVFVAAAGFCLINVLVRQGEVAPLPDAASWGNILLLALVPTVISNLALVVAVRNIGSTLTSALGAMEPLTSVLVGVWVFDEVLGASAIVGMGCILIAVGLIVFSEPLELMLRRRR

SEQ ID NO: 313 - protein, 1122 aa, Porphyromonas gingivalis
MIKSPQPIDILSLFRRHNGVQALMKALDREKCVALDGLCGSSAALIVKLLHESGRPVLCIASDMEEAGYLFSDLEQLGGEGSALFFPSSYKRAIKYGHTDAAQQVLRAEALAALSMEGSCPLVVSYPEAVAERVVAGDILEKEMHSIRQGDRLDRDFLRDLLLEWGFERTDYVYEPGQFAVRGSLLDVFSFSRELPVRIDFFDDEIESIRLFEVESQLSVGTLSEVVLMPDVAGDVRAEECLLGLFPKNTIIVLPDRPFLEDRLQMVFTDAPLFDDGEGFESLVAMQERLTSPKELMDKLNDFTTIATGSGRSGNYRIGFKTQPQPLFHKNFDLLIDQLEQWRDAGYRMLLATASDKQYERVEEILSERGSSSLLPKRVSLTLHEGFSDEALRIVLLTDHQLFDRYHKYNLKSDKARSGKVTLSLKELNQFSQGDYIVHIDHGIGRFGGLITTDVGGKRQEVIKLIYRNNDIIFVNLHSLHKLSKYKGGDSDAQVELSRLGTGAWQKLKERTKKRVKDIARDLIRLYAQRKEERGFAFSPDSYLQHELEASFLYEDTPDQERATAEVKADMESDRPMDRLICGDVGFGKTEVAVRAAFKAATDGKQVAILVPTTVLAYQHYQTFRDRLQNFPVRIEYISRARSAKDIKAILHDLAEGRIDIIIGTHRLVSNDIRFHDLGLLVIDEEQKFGVAVKEKLRKLQVNVDTLTMSATPIPRTLQFSLMGARDLSNINTPPPNRYPVATELARFSPDIVREAVNFEMSRNGQVFIVHNRIDNIEEIAGIVQREVPDARVAVGHGRMSPTELERLILDFVHYEYDVLVATTIIENGIDVPNANTIIIDDAHRYGLSELHQLRGRVGRSNRKAFCYLLSPPLSVLSDDSRRRLQAIENFSDLGSGIRIALQDLDIRGAGNVLGAEQSGFIADLGYETYSKVFNEAVSELKADEFADLYAESQEAIPSASRFVVETTVESDLELSFPEEYVPLDSERILLYRELDNLSTDEELDAFRRRMQDRFGKIPPEGEELIRVPRLRRLGRSLGIEKIVLRGDQMSFHLVGKEDSPYYQSEVFGMLLEYIAAHTRRCEIRQSGGKRIVRLREVPDVLTACELCTAISTRSSAERIEL

SEQ ID NO: 314 - protein, 1908 aa, Porphyromonas gingivalis
MMNIRIIFSLFLALTIGLTAMNAQNPYATLEKELEQYRQERRPRKVAETLKKIRVMAESRRDVPMLLHSMFLYDDPENDINDYPEEPLMNDLDKLMQASWLRPVDRAMILFMRLRMYVRYGQFGPAYMMDAVHGDPKDNRLSLWSEKQFEDAFLRDFDVFLSYRKALLQARTEDFRPLFESQPKKCAAPPRSLYQSCISVLALAVGSSSEADGKISHALEQELRQAASYLSDRRERLEMETDRLDYEKRCRKLDDAASYRRMDELIAAYSDLPDVIGMVDRRVNAYCDEEEYVSALDLCNSYLSKYPEAPRINLLKSSRASRILASFVKCDYPLRLHTRLPKSMRIASRNVGSVLISLYWLDMNGSQAADIRQEDLHLYAKGTPFWTESIRTQGRADMKMDSIRCTLPDLPKGVYLVKASAEQCVLEKTKPVPQYSLLHVSDLFFLAQQAMPGVQVLDALTGKPVEGASVDASMRYSIDRSVHTLSPTDRYGRIDLPKSYNRFFPYTDGDRSYPVVSAYTYKQDQVDLSKKNERKYIVSTDRAIYRPGQKVHFFGQCDRIGYAVEDARAIGGSEVEVVLEDANSKEIGRLLCQADEMGRFSGSFDLPTGILNGLFGLRVGGDTYPFSVEEYKRPTFEVGLRSPDAAYAMGDTLRIRGEAKTFTGIGMRGATVNYRLSLTPYTRRWWGRPVADRVVQTGEAVVDESGYFVIPVSLSRPEGREDYSYCLYTLSADVTAPGGETQAAVLRIPVGKEPKRVDVEVGKYIRANEDNWLATSLPDLTFSLTNTSGQTVEGSIAYFLCDADNERIGRLYTAASGVVTPAPAEWGKLPSGQYRLRFGESGGEDSDFVTKDVYLFRPKDRQLSNPSQGLWTYVAEEKYDSHRPARILVGATPKDADAQELYLFYDLTQAGRFIERKMIACRPGEIVEIVPMLPAAPLPESMNVSLYYVYGGRLYSRSIDLERRLPKREIKMSWSTFRDKLRPGEKETWKLRLADAEGKPLSHTMMAAWMYDAALDKIVHSSVFSSRFFSFADSPASLVRLSFPNSGYRVSGFVEDSYVQVGFKHPVFKTPQLCLWSATGYRYVSSDYYYDGPMIFVGYGVPEAKSVDAFPMEEKAARADAVNEAEPESKESGIQESSVRTNFAETAFFEPALLTDERGEVSWSFTLPETLTRWHLLLFAHTKDMRLGMKDESVEVRKDFMLTPNLPRFLRMGDKGTASASIRNGSETMQQGFVRMELFDPATDKLLGGERLPFSVEAGGTVTVSFPLDPVSGYDALGVRLLAESHDFSDGEQHSIVQLPATERVVETIPLILYGGQSQTVDLDSLFPHRSGRPAMGTMALQVVSNPLWVAVQALPVMTDVHEEDAVSVASALYANSIAAALVSGRLLHTPALGESLRHYLAQPLDTLALQKSPLSSDELPWRAEMLAEQNNRQRLQALVASDRLTWTEQMLTDKLKRLQKSDGSWAWHPEMSSNDYLTDYVMTMLVRLSALTAAPEHKEFQAVKRMGWNALDDAASRLMDRMKEYEKKTKSKYKILPERALNYLYLLTIDSRNPSSRGHAARMYFLDILGRSLPHISILDMPRAAIVLHGVGRKALADDFLRSIREHIIRTPDQGAHFALPSGGYYWCDRRYGMQTEAIEAFARIGTSQDSSHIEGLQMWLLNQKRTQLWPSLPASSDAIYALLLGAGKDRMVEATVSVRAPVPALSGTFAGAGESRIVTVEDLPQGKLSAELARSGKGFAWASFLAEYDAPAADLVATGNGLSVEKHLFSEQVIDGKLTLVPLREGDRLEVGKRLVTQLTITLDRDMDFIVLTDKRTAAVEPIGQLSGYDYAAGTFYYREIKDSSTRFYFDRLVRGSYKLQYSTVVVRSGAYASGIATVSSAYAPEFTGHTDGGRQLQTVPVANTQ

SEQ ID NO: 315 - protein, 908 aa, Porphyromonas gingivalis
MEKKRVYTFGNGKAEGEAGMKNLLGGKGANLAEMNLIGVPVPPGFTITTEVCQEYYTLGRDKVVELLRGEVNDAIRNIEGLMKSKFGDTENPLLVSVRSGARASMPGMMDTILNLGLNDEVVAGIVRKTGNERFAWDSYRRFVQMYGDVVLGMKPTNKEDIDPFEEIIEKVKEENGVHLDNELSVENLKDLVSRFKAAVKAQTGKDFPFSAEEQLWGAIMAVFDSWMNERAILYRRMEGIPAEWGTAVNVQAMVFGNMGETSATGVCFSRDAGSGEDLFNGEYLINAQGEDVVAGIRTPQQITKIGSQRWAERAGIAEDVRVAQYPSMEEAMPEIYKELDTLQQKLEDHYRDMQDMEFTVQEGKLWFLQTRNGKRTGCAMVKIAMDLLRQGMISEEEALMRVEPNKLDELLHPIFDKSALLRARVLTKGLPASPGAATGQIVFFADDAAQWKEDGKRVVMVRIETSPEDLAGMSAAEGILTARGGMTSHAAVVARGMGKCCVSGAGALNIDYKARTVEIDGTLFKEGDYISINGSTGEIYEGQVETKAAEMDQDFADLMALADKYAKLKVRTNADTPHDAEIARSFGAVGIGLCRTEHMFFEGEKIKAMREMILSETAEGRVRALAKILPYQQEDFKGIFRAMNGFPVNVRLLDPPLHEFVPHDLKGQEEMARMMGVDVRIIQKRVEDLMEHNPMLGHRGCRLGNTYPEITEMQTRAILGACLELKKEGVVCLPEIMVPLTGILHEFKHQEEVIRATAAKLFEEKGDSVEFQVGTMIEVPRAALTADRIASSAEFFSFGTNDLTQMTFGYSRDDIASFLPIYLDKKILKVDPFQVLDQKGVGQLVRMATENGRKARPNLKCGICGEHGGEPSSVKFCHRVGLNYVSCSPFRVPIARLAAAQAVIEEGK

SEQ ID NO: 316 - protein, 102 aa, Porphyromonas gingivalis
MKRLTPIGLLEKEQVRFVGLALSFFVPNLGSEAYPEHTVIPLFGGLDPKRKTQGSLIEFIFYSSSSIKTTNMWGDGKEKYQSVGIVRGAIIIVLCNDFSEHL

SEQ ID NO: 317 - protein, 181 aa, Porphyromonas gingivalis
MMTMTICWTPICVQLIKLSGIFIAAYLAYRYAVHKLSKESIENIERCKYQAVLEAHRSFYKLLRFTTDTENADSILVWQKAKGGGAKTYYFRPACIRGFLSELTAEFYKNGNGIFLSKEIISRIFEYRSIVYGLLLSERQNSDERVVMNKPETAERMISIHQELTQTVREAIALKKRTLNF

SEQ ID NO: 318 - protein, 429 aa, Porphyromonas gingivalis
MSYLFTSESVSEGHPDKVSDQISDAILDQFLATDPDSKVACETLVTTGQVVLAGEVKSRSYVDVQETARRVIERIGYTKSEYGFDTRSCGIFSSIHEQSADINRGVDRSDRSEQGAGDQGMMFGYATNETENYMPLTVDLAHHLLYELAAIRKEPSSPMPYLRPDAKSQVTIEHDDEGRPVRIDTIVISTQHDEFVQASDGISEAEADRMMQERIHHDIATILIPRVKMLYKPEIAALFDEKVRLFVNPTGKFVIGGPHGDTGLTGRKIIVDTYGGRASHGGGAFSGKDPSKVDRSAAYAARHIAKNMVAAGVADEMLVQVAYAIGVAEPVSIYVNTKGRSHVALSDGQIAEKIKKIFDMRPYAIEQRLKLRNPIYEETAAYGHFGREPYEAYKTFVDEHGTEQMRIVELFTWEKLDYVDKIRAEFGLS

SEQ ID NO: 319 - protein, 941 aa, Porphyromonas gingivalis
MELKRFLSLGLLLVGFIPMKLSAQQAQPLPTDPAVRVGKLDNGLTYFIRHNENPKDRADFFIAQKVGSILEEDSQSGLAHFLEHMAFNGTKNFPGKNLINYLETIGVRFGQNLNASTGFDKTEYTIMDVPTTRQGIIDSCLLILHDWSNNITLDGHEIDEERGVIQEEWRARRDANLRMFEAILAKAMPGNKYAERMPIGLMDVVLNFKHDELRNYYKKWYRPDLQGLVIVGDIDVDYVENKIKELFKDVPAPVNPAERIYTPVEDNDEPIVAIATDAEATTTQLSISFKSDPTPQEVRGSIFGLVEDYMKQVITTAVNERLSEITHKPNAPFLSAGAFFSNFMYITQTKDAFNFVATVREGEAEKAMNALVAEIESLRQFGITKGEYDRARTNVLKRYENQYNERDKRKNNAYANEYSTYFTDGGYIPGIEVEYQTVNAFAPQVPLEAFNQAIAQMIDPVKNAVVTLTGPSKAEAKIPSEADFLAAFKAARQQKVEAKKDEVSDQKLMEKAPKAGKIVSEKKDQKFGTTELTLSNGIKVYLKKTDFKSNEILMSALSPGGILSGKHAPNQSVMNSFMNVGGLGNFDAIQLDKVLTGRSASVSPSLSLLSEGLSGKTTVEDMETFFQLIYLQMTANRKDPEAFKATQEKLYNNLKNQEANPMAALMDSIRHTMYGDNPMMKPMKAADVEKVNYDQVMAFYNERFADAGDFMFFFIGNLDEAKMKPLIETYLASLPNLKRGDKMNKAQVPAARSGKIDCKFEKEMDTPSTTIFDVVSGNVEYTLKNSLLLEVFSAVMDQVYTATVREKEGGAYSVAAFGGLEQYPQPKALMQIYFPTDPARAEEMNAIVFAELEKLAKEGPNVEYFKKTIENLNKQHKESLRENRFWLEAMKASFFEGNDFITDYESVLNGLTPAELQKFAADLLKQQNRVVVMMAPVAKAQ

SEQ ID NO: 320 - protein, 188 aa, Porphyromonas gingivalis
MEAEIFPGTIHLIDKPQAIPEAIRLLSASRTIGFDTETRPSFVRGARPSVALMQMSTETDCFLFRLNMIDIPEELQQLLENPGILKVGLSLSDDMTVIRRRKPIEPAGFVELQRLCPAYGIRDASLQKIYAILFGRRISKSQRLTNWEARTLTAAQQSYAALDAWACLRIFNQLMTLPTPTPVQFALL

SEQ ID NO: 321 - protein, 1039 aa, Porphyromonas gingivalis
MLNKIIRFSLNNRLTILVASVLLMLVGTYTASNMEVDVFPDLNAPTVVVMTEATGMAPEEVERLVTFPVETAVNGATDVRRVRSSSTTGFSIVWVEFDWGTDIYRARQIVSEKLAVVGADLPDNVGKPTLGPQSSILGEVMIIGLTADSTSLQDLRTLADWTIRPRLLSIGGVAQVTVLGGDIKEYQILLNPERMKHYGITLAEVRAAVDQMNRNASGGVLYEYGNEYIICGLLSTNDAAALGKTLVKSLDDIPIMLESVAEVRVGNKAPKLGLASERGQSAVLVTITKQPATSTLELTERLDRSLADLQKALPSDVKVSTDIFRQERFIENSISNVRKALYEGGIFVVIVLFIFLMNARATIISLVTIPLSLVASFLTLKLMGLTINTMSLGGMAIAIGSLVDDAIVDVENVYKRLRENRMKPREEQDTVLNVIFEASKEVRMPILNSTFIIIASFVPLFFLSGMEGRMLVPLGIAFIIALLASTIVALTLTPVLCSYLLAKRKKDDSPEKEPIVAKKLKGWYGQALQWSLGNTKKVLLMTGGVLVAALIVFFTLGRSFLPPFNEGSFTINVSTLPGISLEESDRMGRMAEEILLSVPEVQTVGRKTGRAELDEHALGVNVSEIEVPFVLKDRSKDEVLADIREKLKVLPGVNIEIGQPISHRIDAMLSGTRANIAIKLFGPDLNRLFAIGNQIKTSVHDVKGVADLNVEQQVERPQLKIVPKREMLAKYGLTPASFAEIVNVMLAGEVVSQVYEGNRSFDLSLKVNDESRESADRIRDLIIDAGGRKIPFAYVADIVSASGPNTINRENVSRKIVVSANVAGRDLRSVVNDIQERIDADITLPEGYHIEYGGQFESEQAASRTLLVTSVFFILVIFLLLFNQFRSLSQSAVSLLNLPLALIGGVFAIFFTGGIISIPAIIGFISLFGIATRNGMLLISRYNDLQQAGLSPYESVLRGSLDRLNPILMTALTSGLALIPLALGGELPGNEIQSPMAKVILGGLFSSTILNAFIVPIMYLLTDKSYRERTFRNRQLTIE

SEQ ID NO: 322 - protein, 1039 aa, Porphyromonas gingivalis; identical to SEQ ID NO: 321

SEQ ID NO: 323 - protein, 1039 aa, Porphyromonas gingivalis; identical to SEQ ID NO: 321

SEQ ID NO: 324 - protein, 1324 aa, Porphyromonas gingivalis; identical to SEQ ID NO: 254

SEQ ID NO: 325 - protein, 412 aa, Porphyromonas gingivalis
MEYCRLDGDTGRLRTEIKHPRLLLFNPGHEMVPEIIGKKPYVPPPVVRSMMRDLGLLPAWLTKSEQDFVFCPEKTLPIPDTHPLKPEARLLQIPDTALPLNDYTLDMWGQSPVWLAALQHRFLWLSTVSAPYYPHELYERSHRCEAARCLEAIGHSEMAAHWFTSINDFLKERYHCFPPDSALLAKLPSSSSGRGLIWLSSSPTDDEIDLLTKALRRAGSFSVEPVLDVRQDWAAEFYSNGKGELYFVGWSRFDTNRWGAYLGNRLATQTDLVAELTQTVGAQAHEEAIASVKDYLRERFASLYTGYIGVDMAVYAERDSLFLHPCIEINVRYTMGVAAILLYDLWIEKGRRGVFEVKGFRTEGEAHEWDSMMQCSHPPLIMDGRLRAGYLPLTITDRSSRFLAYLLITEDR

SEQ ID NO: 326 - protein, 417 aa, Porphyromonas gingivalis
MDRKIEKKKTLIPRKYYPYAGGAIVILALAAWAVFGNHSTKFRAERARISIDSVRQGEFNDYVRINGQVQPINSIQISAVEGGMVAEKTVEEGAMVHKGDIIVRLTNPMLNLNILDSEAQLAEKQNFLRNTQVTMEQDRLNLKRESLNLRLDIERKKRKAEQYARLYKEKLCSREEYLQAGEDYQYAVEGSRLVMERQRQDSLYRGIQVRQMEESLHNMRRNLEMVRARVEDLNVKAPADGQLGLLDVEIGQTVGAGSRIGQINVLSDYKVEAMIDEHYIDRVKAGLAASFERQGRDFSLRVRKVYPEVRDKQFRTDFIFDGERPDNIRTGQTYYINLRLGQPSEAIMIPRGAFYQNTGGRWIFVVTPDGKRAVRRDITIARQNPQYYEVTSGLHAGEMVITSSYDMFGDAEEIILN

SEQ ID NO: 327 - protein, 178 aa, Porphyromonas gingivalis
MSQKPTNDRKIILITGGQRSGKSLYAEQMALALSAHPIYLATARIWDDEFAQRVAVHRERRGSEWTNIEEEKVLSRHNPLGEVILIDCLTLWATNYFFDNDSDVELAYAALCAEFDSFTSHSGTFIFVTNEIGLGGVAENAVQRHFADLLGRLNQYVAARADRVVLMISGIPMVIKGD

SEQ ID NO: 328 - protein, 170 aa, Porphyromonas gingivalis
MIFRSFVGFWLISLSENSFVMRTKIKYPVQTCRPCELLPSVLMEEADRKTGVKLHADTDFHNKKDDEAYLVFSERFWPKRFYEPKVSRLWFVFLKIYARVFFRFGSRNYFFPNQKQKIAAPRFLVPQMIIFLYVQAYPNYPPDKKFLPPEYRRELLTELLADDTILNDRG

SEQ ID NO: 329 - protein, 336 aa, Porphyromonas gingivalis; identical to SEQ ID NO: 214

SEQ ID NO: 330 - protein, 480 aa, Porphyromonas gingivalis
MLTKLKTLLLGCSLACIGFSCSNHPVLTNADDVEQPLDSGYITLDLRSNLHLSRKGGTHDPLQSVRRITFLFFHETDSKLLLSRTVEPTSDLSFDLKIPKQNYRLAVLVNSGSSYAAIIPEILLPTTAIQATSQTLFESFAAYETGNITSESEHSVTMANDQGLIKLLSTQIVDKKSQLSEASRLSVNVEPCLARVLVVGKPTISGGEYTGDVSCYVIDVVPQRIYPLRHLAKLSSGTNEAYGDNSPLADRYASSWAEESIAAGVAYNNVYGYVKADMFDNPVAATKMQEKKTDFNLNQVAIYTKESTVNPKNYFTAYVPRVVLRAKYVPHGIPGVKPDEGWIEFQGRKMSLEQFKKYVDNPVSAGMALADSIKKAKADNSLVYTGGFVSHGIQFYYKSQNYYAIPIRHFDDEKAPNKDSYGRFGLVRNNEYILSVKSITGAGSPIVPPVSTTEAIEKEGYLPASIAVNQTTAHEQDVDL

SEQ ID NO: 331 - protein, 297 aa, Porphyromonas gingivalis
MKKAFLLGLAGIFFAQTAIAGNAAQGVPDTTVRIEDKVLVINETEDDIDIMLYRYNPDGTRGRSEQVFKGVYLKGRSIEQRFRNTIFDVPLNLTRSNKCSGDKRIRSIGSGSFKLGFVNLTGYAGEHINASSSLRYTLGLMSVSYRLNDWLVIAPNLDIEFNSIHLKNNYSFQDVEGLTQVLPAAEGVTYDNSRLHITYMNVAVPFMMKKCRSSFSLYAAPVLKFKTASSSKVWLPDNKSHQKHGRDLNLNPIVLEARVGINYSAFNLYGSYTLTPLFRSGKGPDTRMFAIGFGFGF

SEQ ID NO: 332 - protein, 400 aa, Porphyromonas gingivalis
MNETPDTIERFLYYLRYEVHASERTVCDYAQDLNRYAAFFSEHTGEVFEPSERDKDVARAWLFSLMEAGQKSSSVQRRLSALKSFYKYMVKIGLIGQSPVRMLRGPKKERPLPVFVPNNEMEKVLNKPIREDDFEAVRDRLILETLYEVGLRRSEIATLKDSAVEDKAGCIRIIGKRNKERIVPFGKRLQDMIDNYRNIREEKVGKSDFFFVSLDGRPLTGEVVYKIVRTALANVPHLTKRSPHVLRHSFATEMLNHGADLISVKELLGHDSLSTTVQYTHISFEQLRQMYNAHPRAKKETTMTDVRIQALHFDATDQLKDFVQKKISKLNRLSDGITGAEVVLKLVKPETVQNKEASIRLYIPGDDLFAEKIADTFEEAIDLTVDALKRQIEKRKEQRK

SEQ ID NO: 333 - protein, 672 aa, Porphyromonas gingivalis
MSKINIDRIVKDIKSKTTSLTPVIEAVCNSIDAIGSERTDGIIDIIVKRSGQQSLELDTTHTLSDIISIDVIDNGIGFTEENKNSFDTYRSGFKMSKGGKGFGRFMYLKYFYHVSIESIFYEEGKYKQRSFTFGHADEIIENEQIVDIESDSDLHTGTVLHLSSIKSFDLDKGLEVIARKLVERLLVFFVPGGEYTPKITIKEENGSNSIVLNNYIGDNSDIQQIGKEEEFTIKGREDEWDFVVKIYKIYYSAITNKICLTANFREVTESALHNYVPEFKETMFEITEHGTQKNYMIKAYVQGKYLDENVTTERDGFNFGKEDDIYSDLSEKQIMKTTSLIIKTYFSEDIEKRYNDKKQKVEHYVYTTAPWNKTLLKDVDMESIPIGVSEFDLEMRFQKIKFDKEQNARIALKELQDKYSSGDESCDSALEDEANKILKNVTETAKNDLAHYVCQRRRIIELFDDLRKRIDGGKSHKESEMHNLIFPMIKDDREIGYEDHNLWLLDERFNFTQYIASDKVISSSDHKEPDLAIFYESGLFYRNGDNAITSPIAIVEFKRPKRTSYPDEENPINQALRYAGKILAGKYEMPKGVEEVIVDKSVTPVYIYIVCDIVPKIEEFADLAGLAISPDKQGYFGYNPKYNAYIEIKSFKKVIDDAKMRNQIFFKKLGLL

SEQ ID NO: 334 - protein, 408 aa, Porphyromonas gingivalis
MKSQFRSVFYLRSNYINKEGKTPILIRIYLNKERLSLGSTGLSVNAQLWDSEKEKVKGHSAEALEVNRKIEEIRADILTIYKRLEVTVDDLTPERIKSEYCGQTDTLNSIVELFDKHNEDVRAQVGINKTAATLQKYENSKRHFTRFLKAKYNRTDLKFSELTPLVIHNFEIYLLTVAHCCPNTATKILKLFKTITLYGRRHGFLSHDPFVNKRFHTQDSSRGFLTDEEIQRIIGKEISIPRLDLVRDIFIFSCFSGLAYIDVSNLTEDNIVELDGREWIMTRRQKTRVATNIILLDIPKRIIEKYAPVRKNGHLLPILSNQKMNAYLKEIADLCNIRKPLSFHMARYREFYKHQIINRLYCMSIKGGNEKETSELLYSTLFCHFKEPLFVDCKDSDFFNNMIAIEEL

SEQ ID NO: 335 - protein, 618 aa, Porphyromonas gingivalis
MAKEKEKLFSEFPPVSREAWIDKITADLKGVPFEKKLVWRTNEGFNVNPFYRREDIEDLKTTTSLPDEYPYVRSTRMHNEWLVRQDIVVGDNVAEANEKALDLLNKGVDSLGFYLKKVHINVDTLAALLKDIELTAVELNFNCCITRAADLLSAFSAYVKKVGADPNKCHGSVSYDPFKKQLVRGVSNPDWVKMTLPVMDAARELPAFRVLNVNAVNLSDAGAFITQELGYALAWGAELLDKLTDAGYKPEEIASRIKFNFGIGSNYFMEIAKFRAARWLWAQIVGSYGDQYKNETAKIHQHATTSMWNKTVFDAHVNLLRTQTETMSAAIAGVDSITVLPFDVTYQQSDDFSERIARNQQLLLKEECHFDKVIDPSAGSYYIETLTNSIGEEAWKLFLSVEDAGGFTQAAETASIQKAVNASNIKRHQSVATRREIFLGTNQFPNFTEVAGDKITLAQGEHDCNCVKSIEPLNFSRGASEFEALRLATEKSGKTPVVFMLTIGNLAMRLARSQFSSNFFGCAGYKLIDNLGFKSVEEGVDAALAAKADIVVLCSSDDEYAEYAPAAFDYLAGRAEFVVAGAPACMADLEAKGIRNYVHVKSNVLETLRAFNDKFGIR

SEQ ID NO: 336 - protein, 63 aa, Porphyromonas gingivalis; identical to SEQ ID NO: 175

SEQ ID NO: 337 - protein, 31 aa, Porphyromonas gingivalis
MNMYTLNTIIPPIFPADSFAPIAYHAISILG

SEQ ID NO: 338 - protein, 89 aa, Porphyromonas gingivalis
MAKESMKAREVKRAKLVAKYAAKRAALKAEGNYEALQLLPKNASPVRLHNRCSMTGRPKGYMRQFGISRIQFREMASAGLIPGVKKASW

SEQ ID NO: 339 - protein, 158 aa, Porphyromonas gingivalis
MAVSFKVKERKVMINGQPAKIRYAQTLKTGDMDLSEICDLTSKISAVSEGDVRSIINTVTGLVITGLKQGRAISLGELGRFRISLSSKAAKEGEEFTVENIRRARVLFLPGGDIRRACRQIRLKGINMLRPGEQQGGTPSVPDSPEGGGEQGSGGGGL

SEQ ID NO: 340 - protein, 305 aa, Porphyromonas gingivalis
MIPDFQTLMLPLLKCVSDGQEHKYRDIIEHLAAEFEVTDEERKELLASGSKAVFDNRVGWARTYLKKAGLLDSPKRAILIISDLGREILSKNPPKIDTKYLRRFPAFIEFQNGYRNDGETEEESITEKIHEQTPEEVLDKAYQRIRKSLASELLNKVIDLSPAFFERLVVELLVKMGYGGSIKDAGKALGKSGDEGIDGTIKEDKLGLDIIYIQAKRWRPGNVVGRPELQKFVGALAGQGAKKGIFITTSNFTKEALTYTPRNETKIVLIDGEQLTQLMIDYNLGCTTQQTYELKKLDSDYFGEE

SEQ ID NO: 341 - protein, 305 aa, Porphyromonas gingivalis; identical to SEQ ID NO: 340

SEQ ID NO: 342 - protein, 305 aa, Porphyromonas gingivalis; identical to SEQ ID NO: 340

SEQ ID NO: 343 - protein, 417 aa, Porphyromonas gingivalis
MNYLYILITLLLSGFFSGAEIAFLSSDKLRLELDRNRGDLTGRALNLLYRHPDQLVTTLLVGNNIVLVVYGLLMAGLLAAPLAQWIDNDAMIVVLQSVLSTIIILFTGEFLPKAIFKTNANMMMRVFALPIVAIYYLLYPLSKLFTGLSRSFIRLVDKNYVPTTVGLGRVDLDHYLAENMSGENEQNDLTTEVKIIQNALDFSGIQVRDCMIPRNEMIACELQTDIEVLKTTFIDTGLSKIIIYRQNIDDVVGYIHSSEMFRGQDWQKRINTTVFVPESMYANKLMRLLMQRKKSIAIVIDELGGTAGMVTLEDLVEEIFGDIEDEHDTRKIIAKQLGPHTYLVSGRMEIDDVNERFGLSLPESDDYLTVAGFILNSHQNIPQANEVVEIAPYTFTILRSSSTKIELVKMSIDDQSN

SEQ ID NO: 344 - protein, 715 aa, Porphyromonas gingivalis
MATLEKIRGKAGLLIVVVGVALFAFIIGDFLRSGSTFFRQSQEVVLDINGEKIKIYDYQQRLKAMEKRAEQSGTKITDEQRASLNNQLAQQYVQDYVLGQQADKLGLTVSPEELLALIIGDGVQPSMFAQQFFSRFGINGSDRAAVNDFLNHISDKQIKLQPAEQQGYLYEIQSEWQSVEKQIADTRMQEKLGALLTRSYAINDIDARYESGVPSREVAVAQAPISVIGDTSIRATDEEIKKYYNEHKEFFVQKYPSTIVQYISSQVVPSAQDMANAEVEMQKVRTEMQQQSDVEALARNYSDKFVSPSFLTSAELDRMNLGVSITEFIKTATPGEVNIPMLENNHYSLVKLVAKKSGFESLNVAIIALDSANLSKADSLCNALNEGGDFAAAARTFSADPTSRETGGVLTFPNQFTQMPDSTITEAMAQQLHLDTLFSVPSNRVIKMNQDKFVFLAKAFNPKPAVDKYKIAYIGVDANFSDETYNKKFMELNEMLNSGKPFPKLAEQARSKGLSIEENAEVTVFSDHVGNIPSSREIVSWALKAEEDEVNEKIFRCGTDYLVIAAVKDQIPSGYRPVEKIKEQIANQLRVEKQGEKLVADLKAKKLDNLEAYASAMNTKIDTLAGISYSPRGGEAAELAGYAMSTPLTKLSEPFAARNYVMVVKPLTQNEKAAGQSVEAQIAQKRRALGQQTAYRAFRKMLDQVPVTDNRARFY

SEQ ID NO: 345 - protein, 417 aa, Porphyromonas gingivalis; identical to SEQ ID NO: 343

SEQ ID NO: 346 - protein, 715 aa, Porphyromonas gingivalis; identical to SEQ ID NO: 344

SEQ ID NO: 347 - protein, 231 aa, Porphyromonas gingivalis
MNDQINVLLEVLEEIKQQNRELKASISNLPQPTESQGEVENRKNLAGIAKILEEQQEFHRRFREELCQVIAKLGERIYEMKSGITEVRISQDEATDKLLTELQTKQTTPEIKLSKYYLFDVKRWAEWLIWGVMIAVLACVIGWATHLYGVNQALDSHALRYRILRMELGYTQPNIASLDSLFSSEDSSDSIRKLRSRVTNYELAIERQAELQLQQQLLSQEQEALTQQLQQ

SEQ ID NO: 348 - protein, 248 aa, Porphyromonas gingivalis
MNNKTLQQIGEYTKLMQRTFSLPNRWRMSFRELIKEIDKLGVDSVWIVIIISFFIGAVITIQLSLNMTSPLIPRFTIGYSTREIILLEFSSTVMCLILAGKVGSSIASELGTMRVTEQIDAMEVMGVNSANYLILPKIIGFMLFVPVLSIISMSTGIVGGYLACSLVPNLPRSDFEYGLQLFFSPYNVFYSIIKSVAYAFIISSVAGYYGYTVKGGALQVGKASTNAVVQCSILVLVADLLLTNLLLA

SEQ ID NO: 349 - protein, 244 aa, Porphyromonas gingivalis
MIEVREVSKQFEDKKVLNNISATFETGKTNLIIGRSGAGKTVLLKCIIGLIAPTSGEVLYDGRDITIMSESELKILRREVGMLFQGSALFDSMTVMENVMFPMNMFSSDKPAVRRERAKYLLHRVGLSDARHKYPSEISGGMMKRAAIARAIALGPKYLFCDEPNSGLDPKTSLVIDDLIHSLTQEHGITTVVNTHDMNSVKTIGDKIIYIRHGSKEWEGSSATLNSSDCTSLKNFVFAKTMEY

SEQ ID NO: 350 - protein, 576 aa, Porphyromonas gingivalis; identical to SEQ ID NO: 185

SEQ ID NO: 351 - protein, 231 aa, Porphyromonas gingivalis; identical to SEQ ID NO: 347

SEQ ID NO: 352 - protein, 417 aa, Porphyromonas gingivalis; identical to SEQ ID NO: 343

SEQ ID NO: 353 - protein, 715 aa, Porphyromonas gingivalis; identical to SEQ ID NO: 344

SEQ ID NO: 354 - protein, 228 aa, Porphyromonas gingivalis
MNKTIGVVVAMEKEFRLLPDILENKEEIRDAVFRAVVGIVGGHRVIYALSGIGKVAAAVCAGELICRYRPDYLINIGVSGGLGRNVAIHDTVVSTAVCYHDVSCGADIAWGQVQGFPLYYPVSEDLLALFRSLPVPVREGVVCCGDRFLSSSEEQDFVRRTFPDAVAVDMESAALAQVAYIYRVPFIAVRIISDIAGEGRDNFAEYMDFWRKASPATFSILERVFDAM

We claim:

1. A method of detecting the presence of antibodies specific for *Porphyromonas gingivalis* in a test sample comprising: contacting the test sample with isolated polypeptides comprising SEQ ID NO:213 under conditions that allow formation of immunocomplexes between the antibodies and the polypeptides, wherein the polypeptides specifically bind antibodies specific for *Porphyromonas gingivalis*; and detecting the immunocomplexes between the antibodies and the polypeptides, wherein detection of the immunocomplexes between the antibodies and the polypeptides indicates the presence of antibodies specific for *Porphyromonas gingivalis* in the test sample.

2. The method of claim 1, wherein the isolated polypeptides comprise a fusion protein comprising SEQ ID NO:213 and a heterologous polypeptide.

3. The method of claim 1, wherein the amount of immunocomplexes is determined.

* * * * *